(12) United States Patent
Cheng et al.

(10) Patent No.: US 10,351,633 B2
(45) Date of Patent: *Jul. 16, 2019

(54) ENZYMATIC SYNTHESIS OF SOLUBLE GLUCAN FIBER

(71) Applicant: E I DU PONT DE NEMOURS AND COMPANY, Wilmington, DE (US)

(72) Inventors: Qiong Cheng, Wilmington, DE (US); Robert Dicosimo, Chadds Ford, PA (US); Arthur Ouwehand, Inga (FI); Zheng You, Wilmington, DE (US); Mark S. Payne, Wilmington, DE (US); Jian Ping Lai, Wallingford, PA (US); Kristin Ruebling-Jass, Wilmington, DE (US); Steven Cary Rothman, Princeton, NJ (US)

(73) Assignee: E I DU PONT DE NEMOURS AND COMPANY, Wilmington, DE (US)

( * ) Notice: Subject to any disclaimer, the term of this patent is extended or adjusted under 35 U.S.C. 154(b) by 54 days.

This patent is subject to a terminal disclaimer.

(21) Appl. No.: 15/313,347

(22) PCT Filed: May 22, 2015

(86) PCT No.: PCT/US2015/032106
§ 371 (c)(1),
(2) Date: Nov. 22, 2016

(87) PCT Pub. No.: WO2015/183714
PCT Pub. Date: Dec. 3, 2015

(65) Prior Publication Data
US 2017/0218093 A1    Aug. 3, 2017

Related U.S. Application Data

(60) Provisional application No. 62/004,305, filed on May 29, 2014.

(51) Int. Cl.
| | | |
|---|---|---|
| C08B 37/00 | (2006.01) | |
| A21D 13/45 | (2017.01) | |
| A23C 9/13 | (2006.01) | |
| A23G 3/36 | (2006.01) | |
| A23L 2/52 | (2006.01) | |
| A61K 31/716 | (2006.01) | |
| C08L 5/00 | (2006.01) | |
| C12N 9/10 | (2006.01) | |
| C12P 19/04 | (2006.01) | |
| C12P 19/08 | (2006.01) | |
| C12P 19/18 | (2006.01) | |
| A23L 29/30 | (2016.01) | |

(Continued)

(52) U.S. Cl.
CPC ......... *C08B 37/0009* (2013.01); *A21D 13/45* (2017.01); *A21D 13/80* (2017.01); *A23C 9/13* (2013.01); *A23G 3/36* (2013.01); *A23G 9/32* (2013.01); *A23L 2/52* (2013.01); *A23L 7/126* (2016.08); *A23L 7/135* (2016.08); *A23L 21/10* (2016.08); *A23L 29/37* (2016.08); *A23L 33/21* (2016.08); *A61K 31/716* (2013.01); *C08L 5/00* (2013.01); *C12N 9/1051* (2013.01); *C12N 9/246* (2013.01); *C12P 19/04* (2013.01); *C12P 19/08* (2013.01); *C12P 19/18* (2013.01); *C12Y 204/00* (2013.01); *C12Y 204/01002* (2013.01); *C12Y 204/01005* (2013.01); *C12Y 302/01* (2013.01); *C12Y 302/01068* (2013.01); *A23V 2002/00* (2013.01); *C08L 2203/02* (2013.01); *C08L 2203/12* (2013.01); *C08L 2205/16* (2013.01)

(58) Field of Classification Search
CPC ...... C08B 37/0009; C12P 19/18; C12P 19/08; C12P 19/04; C12Y 204/01005; C12Y 302/01068; C12Y 204/01002; C12N 9/1051; C12N 9/246; A61K 31/716; C08L 5/00; C08L 2205/16; C08L 2203/02; C08L 2203/12; A23L 29/37; A23L 33/21; A23L 2/52; A23L 7/126; A23L 7/135; A23L 21/10; A23C 9/13; A21D 13/45; A21D 13/80; A23G 3/36; A23G 9/32; A23V 2002/00
USPC ........................................................ 435/101
See application file for complete search history.

(56) References Cited

U.S. PATENT DOCUMENTS

| | | | |
|---|---|---|---|
| 2,709,150 A | 5/1955 | Virginia et al. | |
| 2,776,925 A | 1/1957 | Corman et al. | |

(Continued)

FOREIGN PATENT DOCUMENTS

| | | | |
|---|---|---|---|
| EP | 03008618 A2 | 1/2003 | |
| EP | 1151085 B1 | 8/2005 | |

(Continued)

OTHER PUBLICATIONS

Giffard et al. Molecular characterization of a cluster of at least two glucosyltransferase genes in *Streptococcus salivarius* ATCC 25975. Journal of General Microbiology (1991), 137, 2577-2593. (Year: 1991).*

(Continued)

*Primary Examiner* — Yih-Horng Shiao

(57) ABSTRACT

An enzymatically produced soluble α-glucan fiber composition is provided suitable for use as a digestion resistant fiber in food and feed applications. The soluble α-glucan fiber composition can be blended with one or more additional food ingredients to produce fiber-containing compositions. Methods for the production and use of compositions comprising the soluble α-glucan fiber are also provided.

6 Claims, No Drawings

Specification includes a Sequence Listing.

(51) Int. Cl.
| | |
|---|---|
| A23L 33/21 | (2016.01) |
| A23L 7/135 | (2016.01) |
| A23L 7/126 | (2016.01) |
| A23L 21/10 | (2016.01) |
| A21D 13/80 | (2017.01) |
| A23G 9/32 | (2006.01) |
| C12N 9/44 | (2006.01) |

(56) References Cited

U.S. PATENT DOCUMENTS

| | | | |
|---|---|---|---|
| 4,649,058 | A | 3/1987 | Schwengers |
| 4,861,381 | A | 8/1989 | Paul et al. |
| 5,141,858 | A | 8/1992 | Paul et al. |
| 6,486,314 | B1 | 11/2002 | Van Geel-Schutten et al. |
| 6,630,586 | B1 | 10/2003 | Fouache et al. |
| 6,867,026 | B2 | 3/2005 | Van Geel-Schutten et al. |
| 7,402,420 | B2 | 7/2008 | Kossmann et al. |
| 7,439,049 | B2 | 10/2008 | Bozonet et al. |
| 7,524,645 | B2 | 4/2009 | Monsan et al. |
| 7,612,198 | B2 | 11/2009 | Fuertes et al. |
| 7,897,373 | B2 | 3/2011 | Monsan et al. |
| 8,057,840 | B2 | 11/2011 | Harrison et al. |
| 8,192,956 | B2 | 6/2012 | Kim et al. |
| 2005/0059633 | A1 | 3/2005 | Van Geel-Schutten et al. |
| 2009/0123448 | A1 | 5/2009 | Bozonnet et al. |
| 2009/0297663 | A1 | 12/2009 | Van Geel-Schutten et al. |
| 2009/0300798 | A1 | 12/2009 | Kok-Jacon et al. |
| 2010/0047432 | A1 | 2/2010 | Harrison et al. |
| 2010/0122378 | A1 | 5/2010 | Frohberg et al. |
| 2010/0284972 | A1 | 11/2010 | Naeye et al. |
| 2011/0020496 | A1 | 1/2011 | Shimada et al. |
| 2011/0081474 | A1 | 4/2011 | Zhou et al. |
| 2011/0178289 | A1 | 7/2011 | Monsan et al. |
| 2012/0034366 | A1 | 2/2012 | Hoffman et al. |
| 2012/0165290 | A1 | 6/2012 | Dijkhuizen et al. |
| 2014/0087431 | A1 | 3/2014 | Payne et al. |

FOREIGN PATENT DOCUMENTS

| | | |
|---|---|---|
| EP | 2365084 A2 | 9/2011 |
| JP | 2001258589 | 9/2001 |
| JP | 2007181452 A | 7/2007 |
| JP | 4473402 B2 | 6/2010 |
| WO | 2006054474 | 5/2006 |
| WO | 2010129839 A1 | 11/2010 |
| WO | 2013036918 A1 | 3/2013 |
| WO | 2015183721 A1 | 12/2015 |
| WO | 2015183722 A1 | 12/2015 |
| WO | 2015183724 A1 | 12/2015 |
| WO | 2015183726 A1 | 12/2015 |
| WO | 2015183729 A1 | 12/2015 |

OTHER PUBLICATIONS

Title: US-15-313-347-10. OM protein—protein search, using sw model. Run on: Nov. 15, 2018, 09:03:21. (Year: 2018).*
NCBI Blast:15313347_SEQ ID No. 10 and ZP_04061534.1. https://blast.ncbi.nlm.nih.gov/Blast.cgi. Access and analyze the Blast protein sequence on Apr. 3, 2019. (Year: 2019).*
Arguello-Morales et al., 'Proteolytic modification of Leuconostoc mesenteroides B-512F dextransucrase,' Antonie Van Leeuwenhoek, Feb. 1, 2005, vol. 87, No. 2, pp. 131-141.
Bozonnet et al., 'Molecular characterization of DSR-E, an -1,2 linkage-synthesizing dextransucrase with two catalytic domains,' Journal of Bacteriology, Oct. 15, 2002, vol. 184, No. 20, pp. 5753-5761.
Brison et al., 'Synthesis of dextrans with controlled amounts of [alpha]-1,2 linkages using the transglucosidase GBD-Z,D2,' Applied Microbiology and Biotechnology, Oct. 16, 2009, vol. 86, No. 2, pp. 545-554.
Brison et al., 'Functional and structural characterization of alpha-(1-2) branching sucrase derived from DSR-E glucansucrase,' J. Biol. Chem., Mar. 9, 2012, vol. 287(11), pp. 7915-7924.

Fabre et al., 'Role of the two catalytic domains of DSR-E dextransucrase and their involvement in the formation of highly alpha-1,2 branched dextran,' Journal of Bacteriology, Jan. 1, 2005, vol. 187, No. 1, pp. 296-303.
Fuglsang et al., 'Biochemical analysis of recombinant fungal mutanases,' J. Biol. Chem., 2000, vol. 275, pp. 2009-2018.
Goulas et al., 'Synthesis of isomaltooligosaccharides and oligodextrans by the combined use of dextransucrase and dextranase,' Enzyme and Microbial Technology, 2004, vol. 35, pp. 327-338.
Hakamada et al., 'Nucleotide and deduced amino acid sequences of mutanase-like genes from Paenibacillus isolates: Proposal of a new family of glycoside hydrolases,' Biochimie, 2008, vol. 90, pp. 525-533.
Hayacibara et al., 'The Influence of Mutanase and Dextranase on the production and structure of glucans synthesized by streptococcal glucosyltransferases,' Carbohydrate Research, Pergamon, GB, Aug. 23, 2004, vol. 339, No. 12, pp. 2127-2137.
Hee-Kyoung et al., 'Functional, genetic and bioinformatic characterization of dextransucrase (DSRBCB4) gene in Leuconostoc mesenteroides B-1299CB4,' Journal of Microbiology and Biotechnology, Jun. 2008, vol. 18, No. 6, pp. 1050-1058.
Igarashi et al., 'Molecular characterization of dextranase from *Streptococcus rattus*,' Microbiol. Immunol., 2004, vol. 18, pp. 155-162.
Jeanes et al., 'Characterization and classification of dextrans from ninety-six strains of bacteria,' Journal of the American Chemical Society, Oct. 20, 1954, vol. 76, pp. 5041-5052.
Kang et al., 'Molecular characterization and expression analysis of the glucansucrase DSRWC from Weissella cibaria synthesizing a $\alpha(1 \rightarrow 6)$ glucan,' Fems Microbiology Letters, Mar. 1, 2009, vol. 292, No. 1, pp. 33-41.
Kang et al., 'Cloning and characterization of a dextranase gene from Lipomyces starkeyi and its expression in *Saccharomyces cerevisiae*,' Yeast, 2005, vol. 22, pp. 1239-1248.
Kralj et al., 'Glucan synthesis in the genus *Lactobacillus*: isolation and characterization of glucansucrase genes, enzymes and glucan products from six different strains,' Microbiology, Nov. 1, 2004, vol. 150, No. Part 11, pp. 3681-3690.
Khalikova et al., 'Microbial Dextran-Hydrolyzing Enzymes: Fundamentals and Applications,' Microbiology and Molecular Biology Reviews, Jun. 1, 2005, pp. 306-325.
Larsson et al., 'Dextranase from penicillium minioluteum: reaction course, crystal structure, and product complex,' Structure, 2003, vol. 11, pp. 1111-1121.
Leemhuis et al., 'Glucansucrases: three-dimensional structures, reactions, mechanism, [alpha]-glucan analysis and their implications in biotechnology and food applications,' Journal of Biotechnology, Jan. 1, 2013, vol. 163, No. 2, pp. 250-272.
Mao et al., 'A novel dextran dextrinase from DSM-2003: purification and properties,' Applied Biochemistry and Biotechnology, Sep. 9, 2012, vol. 168, No. 5, pp. 1256-1264.
Monchois et al., 'Glucansucrases: mechanism of action and structure-function relationships,' FEMS Microbiol Rev., 1999, vol. 23, pp. 131-151.
Monchois et al., 'Cloning and sequencing of a gene coding for an extracellular dextransucrase (DSRB) from Leuconostoc mesenteroides NRRL B-1299 synthesizing only a alpha(1-6) glucan,' Fems Microbiology Letters, Feb. 15, 1998, vol. 159, No. 2, pp. 307-315.
Mountzouris et al., 'A study of dextran production from maltodextrin by cell suspensions of Gluconobacter oxydans NCIB 4943,' Journal of Applied Microbiology, Oct. 1999, vol. 87, No. 4, pp. 546-556.
Naessens et al., 'Dextran dextrinase and dextran of Gluconobacter oxydans,' Journal of Industrial Microbiology & Biotechnology, Aug. 1, 2005, vol. 32, No. 8, pp. 323-334.
Naessens et al., 'Leuconostoc dextransucrase and dextran: production, properties and applications,' Journal of Chemical Technology & Biotechnology, Aug. 1, 2005, vol. 80, No. 8, pp. 845-860.
Sarbini et al., 'In vitro fermentation of linear and α-1,2-branched dextransby the human fecal microbiota,' Applied and Environmental Microbiology, 2011, vol. 77(15), pp. 5307-5315.

(56) References Cited

OTHER PUBLICATIONS

Sarwat et al., 'Production & characterization of a unique dextran from an indigenous Leuconostoc mesenteroides CMG713,' International Journal of Biological Sciences, Oct. 5, 2008, vol. 4, No. 6, pp. 379-386.

Shimamura et al., 'Identification of Amino Acids Residues in *Streptococcus mutans* Glucosyltransferases Influencing the Structure of the Glucan Product,' J. Bacteriology, 1994, vol. 176, pp. 4845-4850.

Shimotsuura et al., 'Biochemical and molecular characterization of a novel type of mutunase from *Paenibacillus* sp. Strain RM1: Identification of its mutan-binding domain, essential for degradation of *Streptococcus mutans* biofilms,' Applied and Environmental Microbiology, 2008, vol. 74, pp. 2759-2765.

Simpson et al., 'Four glucosyltransferases, GtfJ, GtfK, GtfL, and GtfM from *Streptococcus salivarius* ATCC 25975,' Microbiology, Jun. 1, 1995, vol. 141, No. 6, pp. 1451-1460.

Sims et al., 'Characterization of polysaccharides synthesised by Gluconobacter oxydans NCIMB 4943,' Carbohydrate Polymers, Applied Science Publishers, Ltd., Jul. 1, 2001, vol. 45, No. 3, pp. 285-292.

Suyotha et al., 'Domain structure and function of a α-1,3-glucanase from Bacillus circulans KA-304, and enzyme essential for degrading basidiomycete cell walls,' Biosci. Biotechnol. Biochem., 2013, vol. 77, pp. 639-647.

Suzuki et al., 'Structural elucidation of dextran degradation mechanism by Streptoccus mutans dextranase belonging to glycoside hydrolase family 66,' J. Biol. Chem., 2012, vol. 287, pp. 19916-19926.

Tsumori et al., 'Purification and properties of extracellular glucosyltransferase synthesizing 1,6-1,3-X-D-glucan from *Streptococcus mutans* serotype A,' Journal of General Microbiology, Jan. 1, 1985, vol. 131, pp. 3347-3353.

Vettori et al., 'Structural characterization of a new dextran with a low degree of branching produced by Leuconostoc mesenteroides FT045B dextransucrase,' Carbohydrate Polymers, May 1, 2012, vol. 88, No. 4, pp. 1440-1444.

Wang et al., 'Characterization of a novel dextran produced by Gluconobacter oxydans DSM 2003,' Applied Microbiology and Biotechnology, Apr. 16, 2011, vol. 91, No. 2, pp. 287-294.

Yamamoto et al., 'Structure of dextran synthesized by dextrin dextranase from acetobacter capsulatus ATCC 11894,' Bioscience, Biotechnology and Biochemistry, Jan. 12, 1993, vol. 57, No. 9, pp. 1450-1453.

Yamamoto et al., 'Effective dextran production from starch by dextrin dextranase with debranching enzyme,' Journal of Fermentation and Bioengineering, Society of Fermentation Technology, Jan. 1, 1993, vol. 76, No. 5, pp. 411-413.

US Department of Agriculture and US Department of Health and Human Services, Dietary Guidelines for Americans, 2010, 7th Edition, Washington, DC, US Government Printing Office, Dec. 2010.

International Search Report issued for PCT/US2015/032106 dated Aug. 5, 2015.

Written Opinion issued for PCT/US2015/032106 dated Aug. 5, 2015.

\* cited by examiner

ENZYMATIC SYNTHESIS OF SOLUBLE GLUCAN FIBER

CROSS-REFERENCE TO RELATED APPLICATIONS

This application is the National Stage application of International Application No. PCT/US2015/32106, filed May 22, 2015, which claims the benefit of U.S. provisional application No. 62/004,305, filed May 29, 2014, both of which prior applications are incorporated herein by reference in their entirety.

INCORPORATION BY REFERENCE OF THE SEQUENCE LISTING

The sequence listing provided in the file named "20150515_CL6036WOPCT_SequenceListing_ST25.txt" with a size of 636,928 bytes which was created on May 13, 2015 and which is filed herewith, is incorporated by reference herein in its entirety.

FIELD OF THE INVENTION

This disclosure relates to a soluble α-glucan fiber, compositions comprising the soluble fiber, and methods of making and using the soluble α-glucan fiber. The soluble α-glucan fiber is highly resistant to digestion in the upper gastrointestinal tract, exhibits an acceptable rate of gas production in the lower gastrointestinal tract, is well tolerated as a dietary fiber, and has one or more beneficial properties typically associated with a soluble dietary fiber.

BACKGROUND OF THE INVENTION

Dietary fiber (both soluble and insoluble) is a nutrient important for health, digestion, and preventing conditions such as heart disease, diabetes, obesity, diverticulitis, and constipation. However, most humans do not consume the daily recommended intake of dietary fiber. The 2010 Dietary Fiber Guidelines for Americans (U.S. Department of Agriculture and U.S. Department of Health and Human Services. *Dietary Guidelines for Americans*, 2010. 7th Edition, Washington, DC: U.S. Government Printing Office, December 2010) reports that the insufficiency of dietary fiber intake is a public health concern for both adults and children. As such, there remains a need to increase the amount of daily dietary fiber intake, especially soluble dietary fiber suitable for use in a variety of food applications.

Historically, dietary fiber was defined as the non-digestible carbohydrates and lignin that are intrinsic and intact in plants. This definition has been expanded to include carbohydrate polymers that are not significantly hydrolyzed by the endogenous enzymes in the upper gastrointestinal tract of humans, and additionally are not significantly fermented by the microbiota present in the lower gastrointestinal tract. Soluble oligosaccharide fiber products (such as oligomers of fructans, glucans, etc.) are currently used in a variety of food applications. However, many of the commercially available soluble fibers have undesirable properties such as low tolerance (causing undesirable effects such as abdominal bloating or gas, diarrhea, etc.), lack of digestion resistance, high cost or a production process that requires at least one acid-catalyzed heat treatment step to randomly rearrange the more-digestible glycosidic bonds (for example, α-(1,4) linkages in glucans) into more highly-branched compounds with linkages that are more digestion-resistant. A process that uses only naturally occurring enzymes to synthesize suitable glucan fibers from a safe and readily-available substrate, such as sucrose, may be more attractive to consumers.

Various bacterial species have the ability to synthesize dextran oligomers from sucrose. Jeanes et al. (*JACS* (1954) 76:5041-5052) describe dextrans produced from 96 strains of bacteria. The dextrans were reported to contain a significant percentage (50-97%) of α-(1,6) glycosidic linkages with varying amounts of α-(1,3) and α-(1,4) glycosidic linkages. The enzymes present (both number and type) within the individual strains were not reported, and the dextran profiles in certain strains exhibited variability, where the dextrans produced by each bacterial species may be the product of more than one enzyme produced by each bacterial species.

Glucosyltransferases (glucansucrases; GTFs) belonging to glucoside hydrolase family 70 are able to polymerize the D-glucosyl units of sucrose to form homooligosaccharides or homopolysaccharides. Glucansucrases are further classified by the type of saccharide oligomer formed. For example, dextransucrases are those that produce saccharide oligomers with predominantly α-(1,6) glycosidic linkages ("dextrans"), and mutansucrases are those that tend to produce insoluble saccharide oligomers with a backbone rich in α-(1,3) glycosidic linkages. Mutansucrases are characterized by common amino acids. For example, A. Shimamura et al. (*J. Bacteriology*, (1994) 176:4845-4850) investigated the structure-function relationship of GTFs from *Streptococcus mutans* GS5, and identified several amino acid positions which influence the nature of the glucan product synthesized by GTFs where changes in the relative amounts of α-(1,3)- and α-(1,6)-anomeric linkages were produced. Reuteransucrases tend to produce saccharide oligomers rich in α-(1,4), α-(1,6), and α-(1,4,6) glycosidic linkages, and alternansucrases are those that tend to produce saccharide oligomers with a linear backbone comprised of alternating α-(1,3) and α-(1,6) glycosidic linkages. Some of these enzymes are capable of introducing other glycosidic linkages, often as branch points, to varying degrees. V. Monchois et al. (*FEMS Microbiol Rev.*, (1999) 23:131-151) discusses the proposed mechanism of action and structure-function relationships for several glucansucrases. H. Leemhuis et al. (*J. Biotechnol.*, (2013) 163:250-272) describe characteristic three-dimensional structures, reactions, mechanisms, and α-glucan analyses of glucansucrases.

A non-limiting list of patents and published patent applications describing the use of glucansucrases (wild type, truncated or variants thereof) to produce saccharide oligomers has been reported for dextran (U.S. Pat. Nos. 4,649,058 and 7,897,373; and U.S. Patent Appl. Pub. No. 2011-0178289A1), reuteran (U.S. Patent Application Publication No. 2009-0297663A1 and U.S. Pat. No. 6,867,026), alternan and/or maltoalternan oligomers ("MAOs") (U.S. Pat. Nos. 7,402,420 and 7,524,645; U.S. Patent Appl. Pub. No. 2010-0122378A1; and European Patent EP1151085B1), α-(1,2) branched dextrans (U.S. Pat. No. 7,439,049), and a mixed-linkage saccharide oligomer (lacking an alternan-like backbone) comprising a mix of α-(1,3), α-(1,6), and α-(1,3,6) linkages (U.S. Patent Appl. Pub. No. 2005-0059633A1). U.S. Patent Appl. Pub. No. 2009-0300798A1 to Kol-Jakon et al. discloses genetically modified plant cells expressing a mutansucrase to produce modified starch.

Enzymatic production of isomaltose, isomaltooligosaccharides, and dextran using a combination of a glucosyltransferase and an α-glucanohydrolase has been reported. U.S. Pat. No. 2,776,925 describes a method for enzymatic production of dextran of intermediate molecular weight comprising the concomitant action of dextransucrase and dextranase. U.S. Pat. No. 4,861,381A describes a method to enzymatically produce a composition comprising 39-80% isomaltose using a combination of a dextransucrase and a dextranase. Goulas et al. (*Enz. Microb. Tech* (2004) 35:327-338 describes batch synthesis of isomaltooligosaccharides (IMOs) from sucrose using a dextransucrase and a dextranase. U.S. Pat. No. 8,192,956 discloses a method to enzymatically produce isomaltooligosaccharides (IMOs) and low molecular weight dextran for clinical use using a recombinantly expressed hybrid gene comprising a gene encoding an α-glucanase and a gene encoding dextransucrase fused together; wherein the glucanase gene is a gene from *Arthrobacter* sp., wherein the dextransucrase gene is a gene from *Leuconostoc* sp.

Hayacibara et al. (*Carb. Res.* (2004) 339:2127-2137) describes the influence of mutanase and dextranase on the production and structure of glucans formed by glucosyltransferases from sucrose within dental plaque. The reported purpose of the study was to evaluate the production and the structure of glucans synthesized by GTFs in the presence of mutanase and dextranase, alone or in combination, in an attempt to elucidate some of the interactions that may occur during the formation of dental plaque.

Mutanases (glucan endo-1,3-α-glucanohydrolases) are produced by some fungi, including *Trichoderma*, *Aspergillus*, *Penicillium*, and *Cladosporium*, and by some bacteria, including *Streptomyces*, *Flavobacterium*, *Bacteroides*, *Bacillus*, and *Paenibacillus*. W. Suyotha et al., (*Biosci, Biotechnol. Biochem.*, (2013) 77:639-647) describe the domain structure and impact of domain deletions on the activity of an α-1,3-glucanohydrolases from *Bacillus circulans* KA-304. Y. Hakamada et al. (*Biochimie*, (2008) 90:525-533) describe the domain structure analysis of several mutanases, and a phylogenetic tree for mutanases is presented. I. Shimotsuura et al, (*Appl. Environ. Microbiol.*, (2008) 74:2759-2765) report the biochemical and molecular characterization of mutanase from *Paenibacillus* sp. Strain RM1, where the N-terminal domain had strong mutan-binding activity but no mutanase activity, whereas the C-terminal domain was responsible for mutanase activity but had mutan-binding activity significantly lower than that of the intact protein. C. C. Fuglsang et al. (*J. Biol. Chem.*, (2000) 275:2009-2018) describe the biochemical analysis of recombinant fungal mutanases (endoglucanases), where the fungal mutanases are comprised of a $NH_2$-terminal catalytic domain and a putative COOH-terminal polysaccharide binding domain.

Glucans comprising α-(1,6) glycosidic linkages can be enzymatically produced from maltodextrin. The enzyme dextrin dextranase ("DDase"; E.C. 2.4.1.2; sometimes referred to in the alternative as "dextran dextrinase") from *Gluconobacter oxydans* has been reported to synthesize dextrans from maltodextrin substrates. DDase catalyzes the transfer of the non-reducing terminal glucosyl residue of an α-(1,4) linked donor substrate (i.e., maltodextrin) to the non-reducing terminal of a growing α-(1,6) acceptor molecule. Naessans et al. (*J. Ind. Microbiol. Biotechnol.* (2005) 32:323-334) reviews a dextrin dextranase and dextran from *Gluconobacter oxydans*.

Others have studied the properties of dextrin dextranases. Kimura et al. (JP2007181452(A)) and Tsusaki et al. (WO2006/054474) both disclose a dextrin dextransase. Mao et al. (*Appl. Biochem. Biotechnol.* (2012) 168:1256-1264) discloses a dextrin dextranase from *Gluconobacter oxydans* DSM-2003. Mountzouris et al. (*J. Appl. Microbiol.* (1999) 87:546-556) discloses a study of dextran production from maltodextrin by cell suspensions of *Gluconobacter oxydans* NCIB 4943.

JP4473402B2 and JP2001258589 to Okada et al. disclose a method to produce dextran using a dextrin dextranase from *G. oxydans* in combination with an α-glucosidase. The selected α-glucosidase was used hydrolyze maltose, which was reported to be inhibitory towards dextran synthesis.

An "GtfB-type" α-glucosyltransferase that uses α-(1,4) linked glucooligosaccharides substrates instead of sucrose to produce glucooligosaccharides having α-(1,6) glycosidic linkages has also been described. U.S. Patent App. Pub. No. 2012-0165290 to Dijkhuizen et al. describes an GtfB α-glucosyltransferase from *Lactobacillus reuteri* and its use in a method for producing a mixture of glucooligosaccharides having one or more α-(1,6) glycosidic linkages and one or more consecutive α-(1,4) glycosidic linkages by contacting a poly- and/or oligosaccharide substrate comprising at least two α-(1,4) linked D-glucose units with the GtfB under suitable reaction conditions.

The enzymatic addition of α-(1,2) branching to dextrans has been reported. A glucosyltransferase (DsrE) from *Leuconostoc mesenteroides* NRRL B-1299 has a $2^{nd}$ catalytic domain ("CD2") capable of adding α-(1,2) branching to dextrans (U.S. Pat. Nos. 7,439,049 and 5,141,858; Published U.S. Patent Appl. Pub. No. 2009-0123448; and Bozonette et al., *J. Bacteriol.* (2002) 184(20):5723-573). U.S. Patent Appl. Pub. No. 2010-0284972 describes methods and compositions for improving the health of a subject by administering compositions comprising α-(1,2) branched α-(1,6) dextrans. Sarbini et al. (*Appl. Envion. Microbiol.* (2011) 77(15):5307-5315) describes in vitro fermentation of dextran and α-(1,2) branched dextrans by the human fecal microbiota. Brison et al. (*J. Biol. Chem.*, (2012) 287(11): 7915-7924) describes a truncated form of the DsrE glucosyltransferase from *Leuconostoc mesenteroides* NRRL B-1299 (a glucan binding domain (GBD) coupled to the second catalytic domain, CD2 (i.e., GBD-CD2)) that is capable of adding α-(1,2) branching to dextrans.

Various saccharide oligomer compositions have been reported in the art. For example, U.S. Pat. No. 6,486,314 discloses an α-glucan comprising at least 20, up to about 100,000 α-anhydroglucose units, 38-48% of which are 4-linked anhydroglucose units, 17-28% are 6-linked anhydroglucose units, and 7-20% are 4,6-linked anhydroglucose units and/or gluco-oligosaccharides containing at least two 4-linked anhydroglucose units, at least one 6-linked anhydroglucose unit and at least one 4,6-linked anhydroglucose unit. U.S. Patent Appl. Pub. No. 2010-0284972A1 discloses a composition for improving the health of a subject comprising an α-(1,2)-branched α-(1,6) oligodextran. U.S. Patent Appl. Pub. No. 2011-0020496A1 discloses a branched dextrin having a structure wherein glucose or isomaltooligosaccharide is linked to a non-reducing terminal of a dextrin through an α-(1,6) glycosidic bond and having a DE of 10 to 52. U.S. Pat. No. 6,630,586 discloses a branched maltodextrin composition comprising 22-35% (1,6) glycosidic linkages; a reducing sugars content of <20%; a polymolecularity index (Mp/Mn) of <5; and number average molecular weight (Mn) of 4500 g/mol or less. U.S. Pat. No. 7,612,198 discloses soluble, highly branched glucose polymers, having a reducing sugar content of less than 1%, a level of α-(1,6) glycosidic bonds of between 13 and 17% and a molecular weight having a value of between $0.9 \times 10^5$ and $1.5 \times 10^5$ daltons, wherein the soluble highly branched glucose polymers have a branched chain length distribution profile of 70 to 85% of a degree of polymerization (DP) of less than 15, of 10 to 14% of DP of between 15 and 25 and of 8 to 13% of DP greater than 25.

Saccharide oligomers and/or carbohydrate compositions comprising the oligomers have been described as suitable for use as a source of soluble fiber in food applications (U.S. Pat. No. 8,057,840 and U.S. Patent Appl. Pub. Nos. 2010-0047432A1 and 2011-0081474A1). U.S. Patent Appl. Pub. No. 2012-0034366A1 discloses low sugar, fiber-containing carbohydrate compositions which are reported to be suitable for use as substitutes for traditional corn syrups, high fructose corn syrups, and other sweeteners in food products.

There remains a need to develop new soluble α-glucan fiber compositions that are digestion resistant, fermentation resistant by microbiota in the lower gastrointestinal tract, have low viscosity, and are suitable for use in foods and other applications. Preferably the α-glucan fiber compositions can be enzymatically produced from sucrose using enzymes already associated with safe use in humans.

SUMMARY OF THE INVENTION

An α-glucan soluble fiber composition comprising α-(1, 2) branching is provided that is suitable for use in a variety of applications including, but not limited to, food applications, compositions to improve gastrointestinal health, and personal care compositions. The soluble fiber composition may be directly used as an ingredient in food or may be incorporated into carbohydrate compositions suitable for use in food applications.

A process for producing the soluble glucan fiber composition is also provided.

Methods of using the soluble fiber composition or carbohydrate compositions comprising the soluble fiber composition in food applications are also provided. In certain aspects, methods are provided for improving the health of a subject comprising administering the present soluble fiber composition to a subject in an amount effective to exert at least one health benefit typically associated with soluble dietary fiber such as altering the caloric content of food, decreasing the glycemic index of food, altering fecal weight, altering cholesterol metabolism, and possibly providing prebiotic effects.

A soluble fiber composition is provided comprising on a dry solids basis the following:
  a. a range of:
    i. 0% to 50% of α-(1,3) glycosidic linkages; or
    ii. 0% to 40% α-(1,4) glycosidic linkages; or
    iii. any combination of i) and ii);
  b. 1 to 50% of a combination of α-(1,2) and α-(1,2,6) glycosidic linkages;
  c. 0-25% α-(1,3,6) glycosidic linkages;
  d. less than 99% α-(1,6) glycosidic linkages;
  e. a weight average molecular weight of less than 300 kDa;
  f. a viscosity of less than 0.25 Pascal second (Pa·s) at 12 wt % in water at 20° C.;
  g. a digestibility of less than 20% as measured by the Association of Analytical Communities (AOAC) method 2009.01;
  h. a solubility of at least 20% (w/w) in pH 7 water at 25° C.; and
  i. a polydispersity index of less than 26.

In one embodiment, the soluble α-glucan fiber composition comprises less than 10% reducing sugars.

In a further embodiment, the sum of the α-(1,3) and α-(1,3,6) glycosidic linkages in the soluble α-glucan fiber composition as described above ranges from 3 to 50%.

In a further embodiment, the soluble α-glucan fiber composition as described above comprises 15-35% α-(1,4) glycosidic linkages.

In a further embodiment, a carbohydrate composition comprising: 0.01 to 99 wt % (dry solids basis) of the soluble α-glucan fiber composition as described above is provided.

In another embodiment, a food product, a personal care product or a pharmaceutical product is provided comprising the soluble α-glucan fiber composition or the carbohydrate composition as described above.

In another embodiment, a method to produce an α-glucan fiber composition is provided comprising:
  a. providing a set of reaction components comprising:
    i. sucrose;
    ii. an α-glucan substrate having a weight average molecular weight of at least 0.5 kDa, said α-glucan substrate comprising at least 50% α-(1,6) glycosidic linkages;
    iii. a polypeptide comprising an amino acid sequence having at least 90% identity to SEQ ID NO: 6; said polypeptide capable of catalyzing the synthesis of α-(1,2) glycosidic linkages on the α-glucan substrate; and
    iv. optionally one or more acceptors;
  b. combining the set of reaction components under suitable aqueous reaction conditions whereby the polypeptide catalyzes the synthesis of an α-glucan fiber composition comprising 1 to 50% α-(1,2) glycosidic linkages; and
  c. optionally isolating the α-glucan fiber composition.

In a further embodiment, the above method further comprises a step (d): concentrating the α-glucan fiber composition.

In another embodiment, a method to produce an α-glucan fiber composition is provided comprising:
  a. contacting sucrose with at least one glucosyltransferase or a combination of at least one glucosyltransferase and at least one α-glucanohydrolase under suitable aqueous reaction conditions whereby an α-glucan substrate is produced having a weight average molecular weight of at least 0.5 kDa, said α-glucan substrate comprising at least 50% α-(1,6) glycosidic linkages; wherein said α-glucan substrate comprises less than 1% α-(1,2) glycosidic linkages;
  b. contacting the α-glucan substrate produced in (a) with a set of reaction components comprising
    i. a polypeptide comprising an amino acid sequence having at least 90% identity to SEQ ID NO: 6; said polypeptide capable of catalyzing the synthesis of α-(1,2) glycosidic linkages on the α-glucan substrate;
    ii. sucrose; and
    iii. optionally one or more acceptors;
  c. combining the set of reaction components under suitable aqueous reaction conditions whereby the polypeptide catalyzes the synthesis of an α-glucan fiber composition comprising 1 to 50% α-(1,2) glycosidic linkages; and
  d. optionally isolating the α-glucan fiber composition of step (c).

In another embodiment, a method to produce an α-glucan fiber composition is provided comprising:
a. contacting a maltodextrin substrate with
 i. a dextrin dextranase or
 ii. a combination of a dextrin dextranase and at least one
α-glucanohydrolase under suitable aqueous reaction conditions; whereby an α-glucan substrate backbone is produced having a weight average molecular weight of at least 0.5 kDa, said α-glucan substrate comprising at least 50% α-(1,6) glycosidic linkages; wherein said α-glucan substrate comprises less than 1% α-(1,2) glycosidic linkages;
b. contacting the α-glucan substrate backbone produced in (a) with a set of reaction components comprising
 i. a polypeptide comprising an amino acid sequence having at least 90% identity to SEQ ID NO: 6; said polypeptide capable of catalyzing the synthesis of α-(1,2) glycosidic linkages on the α-glucan substrate;
 ii. sucrose; and
 iii. optionally one or more acceptors;
c. combining the set of reaction components of (b) under suitable aqueous reaction conditions whereby the polypeptide catalyzes the synthesis of an α-glucan fiber composition comprising 1 to 50% α-(1,2) glycosidic linkages; and
d. optionally isolating the α-glucan fiber composition of step (c).

In another embodiment, a method to produce an α-glucan fiber composition is provided comprising:
a. providing a set of reaction components comprising
 i. a maltodextrin substrate;
 ii. a dextrin dextrinase;
 iii. a polypeptide comprising an amino acid sequence having at least 90% identity to SEQ ID NO: 6; said polypeptide capable of catalyzing the synthesis of α-(1,2) glycosidic linkages on an α-glucan substrate;
 iv. sucrose; and
 v. optionally one or more acceptors;
b. combining the set of reaction components under suitable aqueous reaction conditions whereby an α-glucan fiber composition comprising 1 to 50% α-(1,2) glycosidic linkages is formed; and
c. optionally isolating the α-glucan fiber composition of step (b).

In another embodiment, a method to make a blended carbohydrate composition is provided comprising combining the soluble α-glucan fiber composition as described above with: a monosaccharide, a disaccharide, glucose, sucrose, fructose, leucrose, corn syrup, high fructose corn syrup, isomerized sugar, maltose, trehalose, panose, raffinose, cellobiose, isomaltose, honey, maple sugar, a fruit-derived sweetener, sorbitol, maltitol, isomaltitol, lactose, nigerose, kojibiose, xylitol, erythritol, dihydrochalcone, stevioside, α-glycosyl stevioside, acesulfame potassium, alitame, neotame, glycyrrhizin, thaumantin, sucralose, L-aspartyl-L-phenylalanine methyl ester, saccharine, maltodextrin, starch, potato starch, tapioca starch, dextran, soluble corn fiber, a resistant maltodextrin, a branched maltodextrin, inulin, polydextrose, a fructooligosaccharide, a galactooligosaccharide, a xylooligosaccharide, an arabinoxylooligosaccharide, a nigerooligosaccharide, a gentiooligosaccharide, hemicellulose, fructose oligomer syrup, an isomaltooligosaccharide, a filler, an excipient, a binder, or any combination thereof.

In another embodiment, a method to reduce the glycemic index of a food or beverage is provided comprising incorporating into the food or beverage the present soluble α-glucan fiber composition.

In another embodiment, a method of inhibiting the elevation of blood-sugar level in a mammal is provided comprising administering the present soluble α-glucan fiber composition to the mammal.

In another embodiment, a method of lowering lipids in the living body of a mammal is provided comprising administering the present soluble α-glucan fiber composition to the mammal.

In another embodiment, a method of treating constipation in a mammal is provided comprising administering the present soluble α-glucan fiber composition to the mammal.

In another embodiment, a method to alter fatty acid production in the colon of a mammal is provided comprising a step of administering the present soluble α-glucan fiber composition to the mammal; preferably wherein the short chain fatty acid production is increased and/or the branched chain fatty acid production is decreased.

In another embodiment, a low cariogenicity composition is provided comprising the present soluble α-glucan fiber composition and at least one polyol.

In another embodiment, the use of the present soluble α-glucan fiber composition in a food composition suitable for consumption by animals, including humans is also provided.

BRIEF DESCRIPTION OF THE BIOLOGICAL SEQUENCES

The following sequences comply with 37 C.F.R. §§ 1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (2009) and the sequence listing requirements of the European Patent Convention (EPC) and the Patent Cooperation Treaty (PCT) Rules 5.2 and 49.5(α-bis), and Section 208 and Annex C of the Administrative Instructions. The symbols and format used for nucleotide and amino acid sequence data comply with the rules set forth in 37 C.F.R. § 1.822.

SEQ ID NO: 1 is the amino acid sequence of the GtfJ18 glucosyltransferase from *Leuconostoc mesenteroides* subsp. *mesenteroides* J18 as reported in GENBANK° gi:356644413 having 2771 amino acids.

SEQ ID NO: 2 is the amino acid sequence of the DsrE protein from *Leuconostoc mesenteroides* NRRL 1299 as reported in GENBANK® gi:23320943 (Bozonnet et al., *J. Bacteriol.* 184:5763 (2002)).

SEQ ID NO: 3 is the polynucleotide sequence encoding the mature *Leuconostoc mesenteroides* subsp. *mesenteroides* J18 GtfJ18 protein without the native signal sequence for expression in *E. coli* BL21 DE3 (wherein the resulting strain recombinantly producing the protein is referred to as "EC0059").

SEQ ID NO: 4 is the amino acid sequence of the mature *Leuconostoc mesenteroides* subsp. *mesenteroides* J18 GtfJ18 protein referred to herein as "mature GtfJ18" or "EC0059" (from the respective *E. coli* strain producing the protein).

SEQ ID NO: 5 is the polynucleotide sequence encoding a truncated version of the GtfJ18 protein from *Leuconostoc mesenteroides* subsp. *mesenteroides* J18 comprising part of a glucan binding domain (GBD) and the CD2 catalytic domain having α-(1,2) branching activity (amino acid residues 1664-2771 of SEQ ID NO: 7) as expressed in *E. coli* BL21 DE3 strain referred to herein as "EC0059T1".

SEQ ID NO: 6 is the amino acid sequence of the truncated GtfJ18 protein having α-(1,2) branching activity referred to herein as "gtfJ18T1" or "EC0059T1" (the respective *E. coli* strain producing the truncated protein).

SEQ ID NO: 7 is the amino acid sequence of a *Streptococcus criceti* HS-6 GtfS glucosyltransferase as found in GENBANK® gi: 357235604 (precursor with the native signal sequence) also referred to herein as "GTF5604". The same amino acid sequence is reported under GENBANK® gi:4691428 for a glucosyltransferase from *Streptococcus criceti*. As such, this particular amino acid sequence is also referred to herein as "GTF1428". Alternatively, the enzyme may also be referred to herein as SG1018 (from the respective Bacillus subtilis strain used to express GTF5604).

SEQ ID NO: 8 is the polynucleotide sequence encoding the full length wild type sequence (including the native signal sequence) of the *Streptococcus criceti* HS-6 GtfS glucosyltransferase GTF5604 that was cloned and expressed in Bacillus expression vector pHYT.

SEQ ID NO: 9 is the amino acid sequence of a *Streptococcus downei* GtfS glucosyltransferase as found in GENBANK® gi: 121729 (precursor with the native signal sequence) also referred to herein as "GTF1729" or "SG1006" (the respective *Bacillus subtilis* strain expressing GTF1729).

SEQ ID NO: 10 is the amino acid sequence of a *Streptococcus salivarius* M18 glucosyltransferase derived from GENBANK® gi: 345526831(also referred to herein as "GTF6831") where the native signal sequence was substituted with the AprE signal sequence for expression in *Bacillus subtilis*. The enzyme may also be referred to herein as "SG1031" (referring to the respective *Bacillus subtilis* strain expressing GTF6831.

SEQ ID NO: 11 is the amino acid sequence of a *Streptococcus sobrinus* glucosyltransferase derived from GENBANK® gi: 22138845 (also referred to herein as "GTF8845") where the native signal sequence was substituted with the AprE signal sequence (SEQ ID NO: 34) for expression in *Bacillus subtilis*. The enzyme may also be referred to herein as "SG1051" (referring to the respective *Bacillus subtilis* strain expressing GTF8845.

SEQ ID NO: 12 is the amino acid sequence encoding the truncated *Streptococcus mutans* glucosyltransferase referred to herein as "GTF0088" or "SG1066" (referring to the respective *Bacillus subtilis* strain expressing GTF0088.)

SEQ ID NO: 13 is the amino acid sequence of a *Lactobacillus animalis* KCTC 3501 glucosyltransferase derived from GENBANK® gi: 335358117 (also referred to herein as "GTF8117") where the native signal sequence was substituted with the AprE signal sequence for expression in *Bacillus subtilis*. The enzyme may also be referred to herein as "SG1115" (referring to the respective *Bacillus subtilis* strain expressing GTF8117).

SEQ ID NO: 14 is the amino acid sequence of the *Streptococcus mutans* NN2025 Gtf-B glucosyltransferase as found in GENBANK® gi: 290580544.

SEQ ID NO: 15 is the nucleic acid sequence encoding a truncated *Streptococcus mutans* NN2025 Gtf-B (GENBANK® gi: 290580544) glucosyltransferase.

SEQ ID NO: 16 is the amino acid sequence of the truncated *Streptococcus mutans* NN2025 Gtf-B glucosyltransferase (also referred to herein as the "0544 glucosyltransferase" or "GTF0544").

SEQ ID NO: 17 is the amino acid sequence of the *Streptococcus salivarius* Gtf-J glucosyltransferase as found in GENBANK® gi: 47527.

SEQ ID NO: 18 is the polynucleotide sequence encoding the *Streptococcus salivarius* mature Gtf-J glucosyltransferase.

SEQ ID NO: 19 is the amino acid sequence of *Streptococcus salivarius* Gtf-J mature glucosyltransferase (referred to herein as the "7527" glucosyltransferase" or "GTF7527")).

SEQ ID NO: 20 is the nucleic acid sequence encoding the *Paenibacillus humicus* mutanase (GENBANK® gi: 257153265 where GENBANK® gi: 257153264 is the corresponding polynucleotide sequence) expressed in *E. coli* BL21(DE3).

SEQ ID NO: 21 is the amino acid sequence of the mature *Paenibacillus humicus* mutanase (GENBANK® gi: 257153264; referred to herein as the "3264 mutanase" or "MUT3264") expressed in *E. coli* BL21(DE3).

SEQ ID NO: 22 is the nucleic acid sequence encoding the *Penicillium mameffei* ATCC® 18224™ mutanase.

SEQ ID NO: 23 is the amino acid sequence of the *Penicillium mameffei* ATCC® 18224™ mutanase (GENBANK® gi: 212533325; also referred to herein as the "3325 mutanase" or "MUT3325").

SEQ ID NO: 24 is the polynucleotide sequence of plasmid pTrex.

SEQ ID NO: 25 is the polynucleotide sequence encoding the dextrin dextranase from *Gluconobacter oxydans*.

SEQ ID NO: 26 is the amino acid sequence of the dextrin dextranase (EC 2.4.1.2) expressed by a strain *Gluconobacter oxydans* referred to herein as "DDase" (see JP2007181452 (A)).

SEQ ID NO: 27 is the polynucleotide sequence of *E. coli* malQ.

SEQ ID NO: 28 is the polynucleotide sequence of *E. coli* malS.

SEQ ID NO: 29 is the polynucleotide sequence of *E.coli* malP.

SEQ ID NO: 30 is the polynucleotide sequence of *E. coli* malZ.

SEQ ID NO: 31 is the polynucleotide sequence of *E. coli* amyA.

SEQ ID NO: 32 is a polynucleotide sequence of a terminator sequence.

SEQ ID NO: 33 is a polynucleotide sequence of a linker sequence.

SEQ ID NO: 34 is the amino acid sequence of the *B. subtilis* AprE signal peptide used in the expression vector that was coupled to various enzymes for expression in *B. subtilis*.

SEQ ID NOs 35-43 and 52-67 are nucleic acid sequences or amino acid sequences of various glucosyltransferases.

SEQ ID NOs: 44-51 are nucleic acid sequence or amino acid sequences of various mutanases.

SEQ ID NO: 35 is the amino acid sequence of *Streptococcus salivarius* Gtf-L glucosyltransferase as found in GENBANK® gi: 662379.

SEQ ID NO: 36 is the nucleic acid sequence encoding a truncated *Streptococcus salivarius* Gtf-L (GENBANK® gi: 662379) glucosyltransferase.

SEQ ID NO: 37 is the amino acid sequence of the truncated *Streptococcus salivarius* Gtf-L glucosyltransferase (also referred to herein as the "2379 glucosyltransferase" or "GTF2379").

SEQ ID NO: 38 is the amino acid sequence of the *Streptococcus sobrinus* Gtf-I glucosyltransferase as found in GENBANK® gi: 450874.

SEQ ID NO: 39 is the nucleic acid sequence encoding a truncated *Streptococcus sobrinus* Gtf-I (GENBANK® gi: 450874) glucosyltransferase.

SEQ ID NO: 40 is the amino acid sequence of the truncated *Streptococcus sobrinus* Gtf-I glucosyltransferase (also referred to herein as the "0874 glucosyltransferase" or "GTF0874").

SEQ ID NO: 41 is the amino acid sequence of the *Streptococcus* sp. C150 Gtf-S glucosyltransferase as found in GENBANK® gi: 495810459 (previously known as GENBANK® gi:. 322373279)

SEQ ID NO: 42 is the nucleic acid sequence encoding a truncated *Streptococcus* sp. C150 gtf-S (GEN BANK® gi: 495810459) glucosyltransferase.

SEQ ID NO: 43 is the amino acid sequence of the truncated *Streptococcus* sp. C150 Gtf-S glucosyltransferase (also referred to herein as the "0459 glucosyltransferase", "GTF0459", "3279 glucosyltransferase" or "GTF3279").

SEQ ID NO: 44 is the nucleic acid sequence encoding the *Aspergillus nidulans* FGSC A4 mutanase.

SEQ ID NO: 45 is the amino acid sequence of the *Aspergillus nidulans* FGSC A4 mutanase (GENBANK® gi: 259486505; also referred to herein as the "6505 mutanase" or "MUT6505").

SEQ ID NO: 46 is the nucleic acid sequence encoding a *Hypocrea tawa* mutanase.

SEQ ID NO: 47 is the amino acid sequence of the *Hypocrea tawa* mutanase as disclosed in U.S. Patent Appl. Pub. No. 2011-0223117A1 (also referred to herein as the "*H.tawa* mutanase").

SEQ ID NO: 48 is the nucleic acid sequence encoding the *Trichoderma konilangbra* mutanase.

SEQ ID NO: 49 is the amino acid sequence of the *Trichoderma konilangbra* mutanase as disclosed in U.S. Patent Appl. Pub. No. 2011-0223117A1 (also referred to herein as the "*T. konilangbra* mutanase").

SEQ ID NO: 50 is the nucleic acid sequence encoding the *Trichoderma reesei* RL-P37 mutanase.

SEQ ID NO: 51 is the amino acid sequence of the *Trichoderma reesei* RL-P37 mutanase as disclosed in U.S. Patent Appl. Pub. No. 2011-0223117A1 (also referred to herein as the "*T. reesei* 592 mutanase").

SEQ ID NO: 52 is the nucleic acid sequence encoding a truncated *Streptococcus oralis* glucosyltransferase (GENBANK® gi:7684297).

SEQ ID NO: 53 is the amino acid sequence encoding the truncated *Streptococcus oralis* glucosyltransferase referred to herein as "GTF4297".

SEQ ID NO: 54 is the nucleic acid sequence encoding a truncated version of the *Streptococcus mutans* glucosyltransferase (GENBANK® gi:24379358).

SEQ ID NO: 55 is the amino acid sequence encoding the truncated *Streptococcus mutans* glucosyltransferase referred to herein as "GTF9358".

SEQ ID NO: 56 is the nucleic acid sequence encoding a truncated version of the *Streptococcus gallolyticus* glucosyltransferase (GENBANK® gi:32597842).

SEQ ID NO: 57 is the amino acid sequence encoding the truncated *Streptococcus gallolyticus* glucosyltransferase referred to herein as "GTF7842".

SEQ ID NO: 58 is the amino acid sequence of the *Lactobacillus reuteri* glucosyltransferase as found in GENBANK® gi:51574154.

SEQ ID NO: 59 is the nucleic acid sequence encoding a truncated version of the *Lactobacillus reuteri* glucosyltransferase (GENBANK® gi:51574154).

SEQ ID NO: 60 is the amino acid sequence encoding the truncated *Lactobacillus reuteri* glucosyltransferase referred to herein as "GTF4154".

SEQ ID NO: 61 is the amino acid sequence of a *Streptococcus gordonii* glucosyltransferase derived from GENBANK® gi: 1054877 (also referred to herein as "GTF4877") where the native signal sequence was substituted with the AprE signal sequence for expression in *Bacillus subtilis*.

SEQ ID NO: 62 is the amino acid sequence of the *Streptococcus downei* glucosyltransferase as found in GENBANK® gi: 121724.

SEQ ID NO: 63 is the nucleic acid sequence encoding a truncated *Streptococcus downei* (GENBANK® gi: 121724) glucosyltransferase.

SEQ ID NO: 64 is the amino acid sequence of the truncated *Streptococcus downei* glucosyltransferase (also referred to herein as the "1724 glucosyltransferase" or "GTF1724").

SEQ ID NO: 65 is the amino acid sequence of the *Streptococcus dentirousetti* glucosyltransferase as found in GENBANK® gi: 167735926.

SEQ ID NO: 66 is the nucleic acid sequence encoding a truncated *Streptococcus dentirousetti* (GENBANK® gi: 167735926) glucosyltransferase.

SEQ ID NO: 67 is the amino acid sequence of the truncated *Streptococcus dentirousetti* glucosyltransferase (also referred to herein as the "5926 glucosyltransferase" or "GTF5926").

SEQ ID NO: 68 is the amino acid sequence of a "GTFB-type" glucosyltransferase from *Lactobacillus reuteri* GENBANK° gi: 189485784 (also referred to as a "4,6-α-glucanotransferase") structurally related to members of the family 70 glycoside hydrolase glucansucrase enzymes (GH70) capable of synthesizing linear isomalto/maltooligosaccharides from maltooligosaccharides.

SEQ ID NO: 69 is the amino acid sequence of a 4,6-α-glucanotransferase from *Lactobacillus reuteri* ML1 GENBANK® gi: 357208772 structurally related to members of the family 70 glycoside hydrolase glucansucrase enzymes (GH70) capable of synthesizing linear isomalto/maltooligosaccharides from maltooligosaccharides.

SEQ ID NO: 70 is the amino acid sequence of a 4,6-α-glucanotransferase from *Lactobacillus reuteri* JCM 1112 GENBANK® gi: 189485784 structurally related to members of the family 70 glycoside hydrolase glucansucrase enzymes (GH70) capable of synthesizing linear isomalto/maltooligosaccharides from maltooligosaccharides.

SEQ ID ON: 71 is the amino acid sequence of a *Neisseria polysaccharea* amylosucrase (E.C. 2.4.1.4) (GENBANK® gi: 4107260) capable of synthesizing maltooligosaccharides from sucrose and an 1,4-alpha-D-glucosyl substrate using the following reaction:

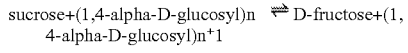

DETAILED DESCRIPTION OF THE INVENTION

In this disclosure, a number of terms and abbreviations are used. The following definitions apply unless specifically stated otherwise.

As used herein, the articles "a", "an", and "the" preceding an element or component of the invention are intended to be nonrestrictive regarding the number of instances (i.e., occurrences) of the element or component. Therefore "a", "an", and "the" should be read to include one or at least one, and the singular word form of the element or component also includes the plural unless the number is obviously meant to be singular.

As used herein, the term "comprising" means the presence of the stated features, integers, steps, or components as referred to in the claims, but that it does not preclude the presence or addition of one or more other features, integers, steps, components or groups thereof. The term "comprising" is intended to include embodiments encompassed by the terms "consisting essentially of" and "consisting of". Similarly, the term "consisting essentially of" is intended to include embodiments encompassed by the term "consisting of".

As used herein, the term "about" modifying the quantity of an ingredient or reactant employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities.

Where present, all ranges are inclusive and combinable. For example, when a range of "1 to 5" is recited, the recited range should be construed as including ranges "1 to 4", "1 to 3", "1-2", "1-2 & 4-5", "1-3 & 5", and the like.

As used herein, the term "obtainable from" shall mean that the source material (for example, sucrose) is capable of being obtained from a specified source, but is not necessarily limited to that specified source.

As used herein, the term "effective amount" will refer to the amount of the substance used or administered that is suitable to achieve the desired effect. The effective amount of material may vary depending upon the application. One of skill in the art will typically be able to determine an effective amount for a particular application or subject without undo experimentation.

As used herein, the term "isolated" means a substance in a form or environment that does not occur in nature. Non-limiting examples of isolated substances include (1) any non-naturally occurring substance, (2) any substance including, but not limited to, any host cell, enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated.

As used herein, the terms "very slow to no digestibility", "little or no digestibility", and "low to no digestibility" will refer to the relative level of digestibility of the soluble glucan fiber as measured by the Association of Official Analytical Chemists International (AOAC) method 2009.01 ("AOAC 2009.01"; McCleary et al. (2010) *J. AOAC Int.*, 93(1), 221-233); where little or no digestibility will mean less than 12% of the soluble glucan fiber composition is digestible, preferably less than 5% digestible, more preferably less than 1% digestible on a dry solids basis (d.s.b.). In another aspect, the relative level of digestibility may be alternatively be determined using AOAC 2011.25 (Integrated Total Dietary Fiber Assay) (McCleary et al., (2012) *J. AOAC Int.*, 95 (3), 824-844.

As used herein, term "water soluble" will refer to the present glucan fiber composition comprised of fibers that are soluble at 20 wt % or higher in pH 7 water at 25° C.

As used herein, the terms "soluble fiber", "soluble glucan fiber", "α-glucan fiber", "cane sugar fiber", "glucose fiber", "soluble dietary fiber", and "soluble glucan fiber composition" refer to the present fiber composition comprised of water soluble glucose oligomers having a glucose polymerization degree of 3 or more that is digestion resistant (i.e., exhibits very slow to no digestibility) with little or no absorption in the human small intestine and is at least partially fermentable in the lower gasterointestinal tract. Digestibility of the soluble glucan fiber composition is measured using AOAC method 2009.01. The present soluble fiber is obtained by the addition of α-(1,2) glycosidic linkages to an α-glucan substrate ("backbone") comprising an effective amount of α-(1,6) glycosidic linkages in the backbone. In one embodiment, the effective amount of α-(1,6) linkages in the α-(1,6) glucan substrate is at least 50%, 60%, 70%, 80%, 90%, 95% or 98% or all α-glycosidic linkages in the molecule. In one embodiment, the present soluble glucan fiber composition is enzymatically synthesized from sucrose (α-D-Glucopyranosyl β-D-fructofuranoside; CAS #57-50-1) obtainable from, for example, sugarcane and/or sugar beets. In another embodiment, the α-glucan substrate ("backbone") having an effective amount of α-(1,6) glycosidic linkages is synthesized from maltodextrins obtainable from processed starch using an enzyme such as a dextrin dextranase where α-(1,2) glycosidic linkages are added using a source of sucrase and a polypeptide having α-(1,2) branching activity. In one embodiment, the α-glucan substrate is first synthesized and then contacted with the polypeptide having α-(1,2) branching activity (sequential reaction design). In another embodiment, the enzyme(s) responsible for synthesizing the α-glucan substrate backbone and the polypeptide having α-(1,2) branching activity are present in the same reaction mixture using an effective amount of sucrose (i.e., a concomitant reaction). In one embodiment, the concomitant reaction comprises a suitable maltodextrins capable of being used as a substrate for a dextrin dextranase, a dextrin dextranase capable of synthesizing an α-glucan comprising an effective amount of α-(1,6) glycosidic linkages, a polypeptide having α-(1,2) branching activity, and an effective amount of sucrose for the additional of α-(1,2) branching. In another embodiment, the sequential or concomitant reactions described above may further comprise an α-glucosidase having endohydrolysis (e.g., a mutanase or dextrinase having endohydrolysis activity). In a preferred embodiment, enzyme(s) used to synthesize the α-glucan substrate "backbone" are selected to produce an α-glucan substrate comprising 1 to 50% α-(1,3) glycosidic linkages, more than 10% but less than 40% α-(1,4) glycosidic linkages, or any combination thereof so long as the polypeptide having α-(1,2) branching activity can introduce α-(1,2) glycosidic linkage to the α-glucan substrate.

As used herein, "weight average molecular weight" or "$M_w$" is calculated as $M_w = \Sigma N_i M_i^2 / \Sigma N_i M_i$; where $M_i$ is the molecular weight of a chain and $N_i$ is the number of chains of that molecular weight. The weight average molecular weight can be determined by technics such as static light scattering, small angle neutron scattering, X-ray scattering, and sedimentation velocity.

As used herein, "number average molecular weight" or "$M_n$" refers to the statistical average molecular weight of all the polymer chains in a sample. The number average molecular weight is calculated as $M_n=\Sigma N_i M_i/\Sigma N_i$ where $M_i$ is the molecular weight of a chain and $N_i$ is the number of chains of that molecular weight. The number average molecular weight of a polymer can be determined by technics such as gel permeation chromatography, viscometry via the (Mark-Houwink equation), and colligative methods such as vapor pressure osmometry, end-group determination or proton NMR.

As used herein, "polydispersity index", "PDI", "heterogeneity index", and "dispersity" refer to a measure of the distribution of molecular mass in a given polymer (such as a glucose oligomer) sample and can be calculated by dividing the weight average molecular weight by the number average molecular weight ($PDI=M_w/M_n$).

It shall be noted that the terms "glucose" and "glucopyranose" as used herein are considered as synonyms and used interchangeably. Similarly the terms "glucosyl" and "glucopyranosyl" units are used herein are considered as synonyms and used interchangeably.

As used herein, "glycosidic linkages" or "glycosidic bonds" will refer to the covalent the bonds connecting the sugar monomers within a saccharide oligomer (oligosaccharides and/or polysaccharides). Example of glycosidic linkage may include α-linked glucose oligomers with 1,6-α-D-glycosidic linkages (herein also referred to as α-D-(1,6) linkages or simply "α-(1,6)" linkages); 1,3-α-D-glycosidic linkages (herein also referred to as α-D-(1,3) linkages or simply "α-(1,3)" linkages; 1,4-α-D-glycosidic linkages (herein also referred to as α-D-(1,4) linkages or simply "α-(1,4)" linkages; 1,2-α-D-glycosidic linkages (herein also referred to as α-D-(1,2) linkages or simply "α-(1,2)" linkages; and combinations of such linkages typically associated with branched saccharide oligomers.

As used herein, "α-glucan substrate backbone", "glucan backbone", "glucan substrate backbone", "substrate backbone" or simply "backbone" will refer to the α-glucan substrate which is acted upon by a polypeptide having α-(1,2) branching activity in the presence of sucrose under suitable aqueous reaction conditions, wherein the net result of the reaction is the addition of at least one α-(1,2) linked glucan to the substrate backbone. Typically the glucan substrate backbone is comprised predominantly of α-1(,6) glycosidic linkages prior to initiating the branching reaction. In one embodiment, the glucan substrate backbone is substantially linear with predominantly α-1(,6) glycosidic linkages and will generally have less than 1% α-(1,2) linkages prior to initiating the branching reaction; especially when the branching reaction is conducted after the glucan substrate backbone has been synthesized. Once the branching reaction is initiated, the polypeptide having α-(1,2) branching activity adds α-(1,2) linked glucose residues to the glucan backbone. As multiple α-(1,2) linked glucose residues may be added during the reaction, the glucan substrate backbone will have an increasing amount (as a percentage of total linkages) of α-(1,2) linked glucan residues. As such, a suitable α-glucan substrate backbone may have more than 1% α-(1,2) linkages so long as the polypeptide having α-(1,2) branching activity is capable of adding additional α-(1,2) linked glucans to the substrate backbone. By proviso, the polypeptide having α-(1,2) branching activity will not include a catalytically active domain capable of adding glycosidic linkages other than α-(1,2) glycosidic linkages. The α-glucan substrate backbone will have a DP of at least 3 and will have at least 50%, preferably at least 60, 70, 80, 90, 95, 96, 97, 98, 99 or 100% α-(1,6) linkages prior to initiating the enzymatic α-(1,2) branching reaction. In one embodiment, the As used herein, the terms "glucansucrase", "glucosyltransferase", "glucoside hydrolase type 70", "GTF", and "GS" will refer to transglucosidases classified into family 70 of the glycoside-hydrolases typically found in lactic acid bacteria such as *Streptococcus, Leuconostoc, Weisella* or *Lactobacillus* genera (see Carbohydrate Active Enzymes database; "CAZy"; Cantarel et al., (2009) *Nucleic Acids Res* 37:D233-238). The GTF enzymes are able to polymerize the D-glucosyl units of sucrose to form homooligosaccharides or homopolysaccharides. Glucosyltransferases can be identified by characteristic structural features such as those described in Leemhuis et al. (J. Biotechnology (2013) 162: 250-272) and Monchois et al. (FEMS Micro. Revs. (1999) 23:131-151). Depending upon the specificity of the GTF enzyme, linear and/or branched glucans comprising various glycosidic linkages may be formed such as α-(1,2), α-(1,3), α-(1,4) and α-(1,6). Some glucosyltransferases may also transfer the D-glucosyl units onto hydroxyl acceptor groups. A non-limiting list of acceptors may include carbohydrates, alcohols, polyols or flavonoids. Specific acceptors may also include maltose, isomaltose, isomaltotriose, and methyl-α-D-glucan, to name a few. The structure of the resultant glucosylated product is dependent upon the enzyme specificity. Examples of glucosyltransferases are provided as amino acid SEQ ID NOs: 1, 2, 4, 6, 7, 9, 10, 11, 12, 13, 14, 16, 17, 19, 35, 37, 38, 40, 41, 43, 53, 55, 57, 58, 60, 61, 62, 64, and 67. In another embodiment, the glucosyltransferase comprises an amino acid sequence selected from the group consisting of 7, 9, 10, 11, 12, 13, 14, 16, and any combination thereof; wherein SEQ ID NO: 6 is a truncated version of a glucosyltransferase capable of adding α-(1,2) branching to a suitable α-glucan substrate backbone. In a further embodiment, a combination of at least one glucosyltransferase and at least one α-glucanohydrolase (such as mutanases and dextrinases described herein) having endohydrolysis activity is used to synthesize the α-glucan substrate "backbone" which can be modified using at least one polypeptide having α-(1,2) branching activity (i.e., SEQ ID NO: 6).

As used herein, the term "Gtf-B type" glucansucrase will refer to polypeptide having 4-6-α-glucosyltransferase activity, such as the GtfB-type glucosyltransferases, typically from strains of *Lactobacillus reuteri*. Examples include, but are not limited to, SEQ ID NOs 68, 69, and 70. It should be noted that the Gtf-B glucosyltransferase from *Streptococcus mutans* (SEQ ID NO: 14, 16) was originally annotated as Gtf-B, but it is not considered what is referred to herein as a "Gtf-B type" glucosyltransferase as it does not have 4,6-α-glucosyltransferase activity.

As used herein, the term "amylosucrase" will refer to an enzyme (E.C. 2.4.1.4) structurally related to GH70 glucosyltransferases that is capable of synthesizing maltooligosaccharides from sucrose and an 1,4-alpha-D-glucosyl substrate using the following reaction:

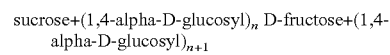

An example of an amylosucrase is the *Neisseria polysaccharea* amylosucrase (GENBANK® gi: 4107260; provided herein as SEQ ID NO: 71).

As used herein, the term "polypeptide having α-(1,2) branching activity" or "enzyme catalyst having α-(1,2) branching activity" will refer to catalytically active glucosyltransferase (or fragment thereof) capable of introducing α-(1,2) glycosidic linkages (using sucrose as a substrate) to an α-glucan substrate "backbone" having an effective amount of α-(1,6) glycosidic linkages. In one embodiment, the polypeptide having α-(1,2) branching activity is a truncated glucosyltransferase comprising a catalytic domain capable of adding α-(1,2) branching to an α-glucan substrate backbone. In one embodiment, the catalytic domain capable of adding α-(1,2) branching further comprises at least one glucan binding domain. Preferably, the polypeptide having α-(1,2) branching activity is a truncated glucosyltransferase wherein the domain capable of synthesizing linkages other than α-(1,2) glycosidic linkage is not present (i.e., the backbone synthesizing domain or "CD1" domain found in enzymes such as the GtfJ18 glucosyltransferase from *Leuconostoc mesenteroides* subsp. *mesenteroides* J18, see GEN-BANK® gi:356644413 (SEQ ID NO: 1) and the DsrE glucosyltransferase from *Leuconostoc mesenteroides* NRRL-1299 as reported in GENBANK® gi:23320943; SEQ ID NO: 2). In a preferred embodiment, the polypeptide having α-(1,2) branching activity comprises an amino acid sequence having at least 80%, 85%, 90%, 91%, 92%, 93%, 94%, 95%, 96%, 97%, 98%, 99% or 100% amino acid identity to SEQ ID NO: 6. In a further preferred aspect, the polypeptide having α-(1,2) branching activity consists essentially of an amino acid sequence having at least 80%, 85%, 90%, 91%, 92%, 93%, 94%, 95%, 96%, 97%, 98%, 99% or 100% amino acid identity to SEQ ID NO: 6.

As used herein, the term "isomaltooligosaccharide" or "IMO" refers to a glucose oligomers comprised essentially of α-D-(1,6) glycosidic linkage typically having an average size of DP 2 to 20. Isomaltooligosaccharides can be produced commercially from an enzymatic reaction of α-amylase, pullulanase, β-amylase, and α-glucosidase upon corn starch or starch derivative products. Commercially available products comprise a mixture of isomaltooligosaccharides (DP ranging from 3 to 8, e.g., isomaltotriose, isomaltotetraose, isomaltopentaose, isomaltohexaose, isomaltoheptaose, isomaltooctaose) and may also include panose.

As used herein, the term "dextran" refers to water soluble α-glucans comprising at least 95% α-D-(1,6) glycosidic linkages (typically with up to 5% α-D-(1,3) glycosidic linkages at branching points) that are more than 10% digestible as measured by the Association of Official Analytical Chemists International (AOAC) method 2009.01 ("AOAC 2009.01"). Dextrans often have an average molecular weight above 1000 kDa. As used herein, enzymes capable of synthesizing dextran from sucrose may be described as "dextransucrases" (EC 2.4.1.5).

As used herein, the term "mutan" refers to water insoluble α-glucans comprised primarily (50% or more of the glycosidic linkages present) of 1,3-α-D glycosidic linkages and typically have a degree of polymerization (DP) that is often greater than 9. Enzymes capable of synthesizing mutan or α-glucan oligomers comprising greater than 50% 1,3-α-D glycosidic linkages from sucrose may be described as "mutansucrases" (EC 2.4.1.-) with the proviso that the enzyme does not produce alternan.

As used herein, the term "alternan" refers to α-glucans having alternating 1,3-α-D glycosidic linkages and 1,6-α-D glycosidic linkages over at least 50% of the linear oligosaccharide backbone. Enzymes capable of synthesizing alternan from sucrose may be described as "alternansucrases" (EC 2.4.1.140).

As used herein, the term "reuteran" refers to soluble α-glucan comprised 1,4-α-D-glycosidic linkages (typically>50%); 1,6-α-D-glycosidic linkages; and 4,6-disubstituted α-glucosyl units at the branching points. Enzymes capable of synthesizing reuteran from sucrose may be described as "reuteransucrases" (EC 2.4.1.-).

As used herein, the terms "α-glucanohydrolase" and "glucanohydrolase" will refer to an enzyme capable of hydrolyzing an α-glucan oligomer. As used herein, the glucanohydrolase may be defined by the endohydrolysis activity towards certain α-D-glycosidic linkages. Examples may include, but are not limited to, dextranases (EC 3.2.1.1; capable of endohydrolyzing α-(1,6)-linked glycosidic bonds), mutanases (EC 3.2.1.59; capable of endohydrolyzing α-(1,3)-linked glycosidic bonds), and alternanases (EC 3.2.1.-; capable of endohydrolytically cleaving alternan). Various factors including, but not limited to, level of branching, the type of branching, and the relative branch length within certain α-glucans may adversely impact the ability of an α-glucanohydrolase to endohydrolyze some glycosidic linkages.

As used herein, the term "dextranase" (α-1,6-glucan-6-glucanohydrolase; EC 3.2.1.11) refers to an enzyme capable of endohydrolysis of 1,6-α-D-glycosidic linkages (the linkage predominantly found in dextran). Dextranases are known to be useful for a number of applications including the use as ingredient in dentifrice for prevent dental caries, plaque and/or tartar and for hydrolysis of raw sugar juice or syrup of sugar canes and sugar beets. Several microorganisms are known to be capable of producing dextranases, among them fungi of the genera *Penicillium, Paecilomyces, Aspergillus, Fusarium, Spicaria, Verticillium, Helminthosporium* and *Chaetomium;* bacteria of the genera *Lactobacillus, Streptococcus, Cellvibrio, Cytophaga, Brevibacterium, Pseudomonas, Corynebacterium, Arthrobacter* and *Flavobacterium,* and yeasts such as *Lipomyces starkeyi*. Food grade dextranases are commercially available. An example of a food grade dextrinase is DEXTRANASE® Plus L, an enzyme from *Chaetomium erraticum* sold by Novozymes A/S, Bagsvaerd, Denmark.

As used herein, the term "mutanase" (glucan endo-1,3-α-glucosidase; EC 3.2.1.59) refers to an enzyme which hydrolytically cleaves 1,3-α-D-glycosidic linkages (the linkage predominantly found in mutan). Mutanases are available from a variety of bacterial and fungal sources. Examples of mutanases are provided as SEQ ID NOs: 21, 23, 45, 47, 49, 51, and any combination thereof; wherein SEQ ID NOs: 21, 23 and combinations thereof is preferred.

As used herein, the term "alternanase" (EC 3.2.1.-) refers to an enzyme which endo-hydrolytically cleaves alternan (U.S. Pat. No. 5,786,196 to Cote et al.).

As used herein, the term "wild type enzyme" will refer to an enzyme (full length and active truncated forms thereof) comprising the amino acid sequence as found in the organism from which was obtained and/or annotated. The enzyme (full length or catalytically active truncation thereof) may be recombinantly produced in a microbial host cell. Depending upon the microbial host, minor modifications (typically the N- or C-terminus) may be introduced to facilitate expression of the desired enzyme in an active form. The enzyme is typically purified prior to being used as a processing aid in the production of the present soluble α-glucan fiber composition. In one aspect, a combination of at least two wild type enzymes concomitantly present in the reaction system is used in order to obtain the present soluble glucan fiber composition As used herein, the terms "substrate" and "suitable substrate" will refer an α-glucan substrate backbone capable of being modified (i.e., the addition of at least one α-(1,2) glycosidic linkage) under aqueous reaction conditions by the polypeptide having α-(1,2) branching activity in the presence of sucrose. The α-glucan substrate backbone can be synthesized (and optionally isolated) prior to the step of enzymatically introducing α-(1,2) branching or may be concomitantly synthesized in the presence of the α-(1,2) branching enzymes (i.e., glucan substrate backbone synthesis is conducted in the same reaction mixture with the polypeptide having α-(1,2) branching activity in the presence of an effective amount of sucrose. The α-glucan substrate may be produced in a variety of ways including, but not limited to, (1) synthesis from at least one glucosyltransferase (using a polypeptide that is different from the polypeptide having α-(1,2) branching activity) in the presence of sucrose, (2) synthesis from maltodextrin obtainable from starch or sucrose (e.g., maltodextrin substrate synthesized from sucrose using an amylosucrase) using a polypeptide having dextrin dextranase activity, a "Gtf-B type" GH70 glucosyltransferase, or a combination thereof, (3) synthesis using method (1) and/or (2) in the presence of at least one α-glucanohydrolase (i.e., dextranase, mutanase, or a combination thereof), and (4) and any combination of (1), (2) or (3) so long as the α-glucan substrate backbone is capable of being acted upon by the polypeptide having α-(1,2) branching activity. In a further embodiment, the α-glucan substrate maybe synthesized prior to the α-(1,2) branching step or may be synthesized concomitant with the α-(1,2) branching (i.e., the polypeptide having α-(1,2) branching activity and an effective amount of sucrose is present in the aqueous reaction mixture). In the context of synthesizing the α-glucan backbone using any of the above embodiments, the "substrate" may be sucrose, maltodextrin, or a combination thereof; optionally in the presence of one or more additional acceptors. In another embodiment, the substrate composition may further comprise one or more acceptors, such as maltose, isomaltose, isomaltotriose, and methyl-α-D-glucan, to name a few. In one preferred aspect, the α-glucan substrate backbone comprises at least 50% α-(1,6) glycosidic linkages. In a further preferred embodiment, the α-glucan substrate backbone comprises 1 to 50% α-(1,3) glycosidic linkages.

In one embodiment, the α-glucan substrate backbone is synthesized using a combination of at least one glucosyltransferase capable for forming glucose oligomers with at least one α-glucanohydrolase in the same reaction mixture (i.e., they are concomitantly present and active in the reaction mixture). As such the "substrate" for the α-glucanohydrolase is the glucose oligomers concomitantly being synthesized in the reaction system by the glucosyltransferase from sucrose. In one aspect, a two-enzyme method (i.e., at least one glucosyltransferase (GTF) and at least one α-glucanohydrolase) where the enzymes are not used concomitantly in the reaction mixture is excluded, by proviso, form the present methods.

As used herein, the terms "suitable enzymatic reaction mixture", "suitable reaction components", "suitable aqueous reaction mixture", and "reaction mixture", refer to the materials (suitable substrate(s)) and water in which the reactants come into contact with the enzyme(s). The suitable reaction components may be comprised of a plurality of enzymes. In one aspect, the suitable reaction components comprises at least one polypeptide having α-(1,2) branching activity, sucrose, and at least one α-glucan substrate having an effective amount of α-(1,6) glycosidic linkages. The α-glucan substrate having an effective amount of α-(1,6) glycosidic linkages in the "backbone" may be synthesized from (1) sucrose using at least one glucansucrase enzyme, (2) maltodextrins obtainable from processed starch or sucrose that have been contacted with at least one dextrin dextranase, at least one "Gtf-B type" glucosyltransferase, and combinations thereof or (3) any combination thereof. The α-glucan substrate "backbone" having an effective amount of α-(1,6) glycosidic linkages may be synthesized prior to enzymatically adding the α-(1,2) branching or may be synthesized concomitantly in the same reaction mixture comprising at least one polypeptide having α-(1,2) branching activity with the proviso that the polypeptide having α-(1,2) branching activity is not the same as the enzyme(s) used to synthesize the α-glucan substrate "backbone" having an effective amount of α-(1,6) glycosidic linkages. In a further aspect, the α-glucan substrate "backbone" to which α-(1,2) branching is added is produced using a single glucansucrase, a combination of glucansucrases, a combination of at least glucansucrase and at least one α-glucanohydrolase, a dextrin dextranase, a "GtfB type" glucosyltransferase (i.e., a 4,6-α-glucanotransferase; Kralj et al., *Appl. Env. Microbiol.* (2011) 77(22): 8154-8163), a combination of a dextrin dextranase and at least one α-glucanohydrolase, a combination of a "GtfB-type" glucosyltransferase and at least one α-glucanohydrolase, and any combination thereof.

As used herein, "one unit of glucansucrase activity" or "one unit of glucosyltransferase activity" is defined as the amount of enzyme required to convert 1 μmol of sucrose per minute when incubated with 200 g/L sucrose at pH 5.5 and 37° C. The sucrose concentration was determined using HPLC.

As used herein, "one unit of dextranase activity" is defined as the amount of enzyme that forms 1 μmol reducing sugar per minute when incubated with 0.5 mg/mL dextran substrate at pH 5.5 and 37° C. The reducing sugars were determined using the PAHBAH assay (Lever M., 1972, A New Reaction for Colorimetric Determination of Carbohydrates, *Anal. Biochem.* 47, 273-279).

As used herein, "one unit of mutanase activity" is defined as the amount of enzyme that forms 1 μmol reducing sugar per minute when incubated with 0.5 mg/mL mutan substrate at pH 5.5 and 37° C. The reducing sugars were determined using the PAHBAH assay (Lever M., supra).

As used herein, "one unit of dextrin dextranase activity" is defined as the amount of enzyme required to deplete 1 umol of amyloglucosidase-susceptible glucose equivalents when incubated with 25 g/L maltodextrin (DE 13-17) at pH 4.65 and 30° C. Amyloglucosidase-susceptible glucose equivalents are measured by 30 minute treatment at pH 4.65 and 60° C. with *Aspergillus niger* amyloglucosidase (Catalog #A7095, Sigma, 0.6 unit/mL), followed by HPLC quantitation of glucose formed upon amyloglucosidase treatment.

As used herein, the term "enzyme catalyst" refers to a catalyst comprising an enzyme or combination of enzymes having the necessary activity to obtain the desired soluble glucan fiber composition. In one embodiment the enzyme maybe alternatively referred to as a "polypeptide having" a specified activity. In certain embodiments, a combination of enzyme catalysts may be required to obtain the desired soluble glucan fiber composition. The enzyme catalyst(s) may be in the form of a whole microbial cell, permeabilized microbial cell(s), one or more cell components of a microbial cell extract(s), partially purified enzyme(s) or purified enzyme(s). The enzyme catalyst may be a truncated version of a wild type enzyme, so long as the desired activity is retained. In certain embodiments the enzyme catalyst(s) may also be chemically modified (such as by pegylation or by reaction with cross-linking reagents). The enzyme catalyst(s) may also be immobilized on a soluble or insoluble support using methods well-known to those skilled in the art; see for example, *Immobilization of Enzymes and Cells;* Gordon F. Bickerstaff, Editor; Humana Press, Totowa, N.J., USA; 1997.

As used herein, "pharmaceutically-acceptable" means that the compounds or compositions in question are suitable for use in contact with the tissues of humans and other animals without undue toxicity, incompatibility, instability, irritation, allergic response, and the like, commensurate with a reasonable benefit/risk ratio.

As used herein, the term "oligosaccharide" refers to homopolymers containing between 3 and about 30 monosaccharide units linked by α-glycosidic bonds.

As used herein the term "polysaccharide" refers to homopolymers containing greater than 30 monosaccharide units linked by α-glycosidic bonds.

As used herein, the term "food" is used in a broad sense herein to include a variety of substances that can be ingested by humans including, but not limited to, beverages, dairy products, baked goods, energy bars, jellies, jams, cereals, dietary supplements, and medicinal capsules or tablets.

As used herein, the term "pet food" or "animal feed" is used in a broad sense herein to include a variety of substances that can be ingested by nonhuman animals and may include, for example, dog food, cat food, and feed for livestock.

As used herein, "personal care products" means products used in the cosmetic treatment hair, skin, scalp, and teeth, including, but not limited to shampoos, body lotions, shower gels, topical moisturizers, toothpaste, tooth gels, mouthwashes, mouthrinses, anti-plaque rinses, and/or other topical treatments. In some particularly preferred embodiments, these products are utilized on humans, while in other embodiments, these products find cosmetic use with non-human animals (e.g., in certain veterinary applications).

As used herein, the terms "isolated nucleic acid molecule", "isolated polynucleotide", and "isolated nucleic acid fragment" will be used interchangeably and refer to a polymer of RNA or DNA that is single- or double-stranded, optionally containing synthetic, non-natural or altered nucleotide bases. An isolated nucleic acid molecule in the form of a polymer of DNA may be comprised of one or more segments of cDNA, genomic DNA or synthetic DNA.

The term "amino acid" refers to the basic chemical structural unit of a protein or polypeptide. The following abbreviations are used herein to identify specific amino acids:

| Amino Acid | Three-Letter Abbreviation | One-Letter Abbreviation |
|---|---|---|
| Alanine | Ala | A |
| Arginine | Arg | R |
| Asparagine | Asn | N |
| Aspartic acid | Asp | D |
| Cysteine | Cys | C |
| Glutamine | Gln | Q |
| Glutamic acid | Glu | E |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |
| Any amino acid or as defined herein | Xaa | X |

It would be recognized by one of ordinary skill in the art that modifications of amino acid sequences disclosed herein can be made while retaining the function associated with the disclosed amino acid sequences. For example, it is well known in the art that alterations in a gene which result in the production of a chemically equivalent amino acid at a given site, but do not affect the functional properties of the encoded protein are common. For example, any particular amino acid in an amino acid sequence disclosed herein may be substituted for another functionally equivalent amino acid. For the purposes of the present invention substitutions are defined as exchanges within one of the following five groups:

1. Small aliphatic, nonpolar or slightly polar residues: Ala, Ser, Thr (Pro, Gly);
2. Polar, negatively charged residues and their amides: Asp, Asn, Glu, Gln;
3. Polar, positively charged residues: His, Arg, Lys;
4. Large aliphatic, nonpolar residues: Met, Leu, Ile, Val (Cys); and
5. Large aromatic residues: Phe, Tyr, and Trp.

Thus, a codon for the amino acid alanine, a hydrophobic amino acid, may be substituted by a codon encoding another less hydrophobic residue (such as glycine) or a more hydrophobic residue (such as valine, leucine, or isoleucine). Similarly, changes which result in substitution of one negatively charged residue for another (such as aspartic acid for glutamic acid) or one positively charged residue for another (such as lysine for arginine) can also be expected to produce a functionally equivalent product. In many cases, nucleotide changes which result in alteration of the N-terminal and C-terminal portions of the protein molecule would also not be expected to alter the activity of the protein. Each of the proposed modifications is well within the routine skill in the art, as is determination of retention of biological activity of the encoded products.

As used herein, the term "codon optimized", as it refers to genes or coding regions of nucleic acid molecules for transformation of various hosts, refers to the alteration of codons in the gene or coding regions of the nucleic acid molecules to reflect the typical codon usage of the host organism without altering the polypeptide for which the DNA codes.

As used herein, "synthetic genes" can be assembled from oligonucleotide building blocks that are chemically synthesized using procedures known to those skilled in the art. These building blocks are ligated and annealed to form gene segments that are then enzymatically assembled to construct the entire gene. "Chemically synthesized", as pertaining to a DNA sequence, means that the component nucleotides were assembled in vitro. Manual chemical synthesis of DNA may be accomplished using well-established procedures, or automated chemical synthesis can be performed using one of a number of commercially available machines. Accordingly, the genes can be tailored for optimal gene expression based on optimization of nucleotide sequences to reflect the codon bias of the host cell. The skilled artisan appreciates the likelihood of successful gene expression if codon usage is biased towards those codons favored by the host. Determination of preferred codons can be based on a survey of genes derived from the host cell where sequence information is available.

As used herein, "gene" refers to a nucleic acid molecule that expresses a specific protein, including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different from that found in nature. "Endogenous gene" refers to a native gene in its natural location in the genome of an organism. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

As used herein, "coding sequence" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, RNA processing site, effector binding sites, and stem-loop structures.

As used herein, the term "operably linked" refers to the association of nucleic acid sequences on a single nucleic acid molecule so that the function of one is affected by the other. For example, a promoter is operably linked with a coding sequence when it is capable of affecting the expression of that coding sequence, i.e., the coding sequence is under the transcriptional control of the promoter. Coding sequences can be operably linked to regulatory sequences in sense or antisense orientation.

As used herein, the term "expression" refers to the transcription and stable accumulation of sense (mRNA) or antisense RNA derived from the nucleic acid molecule of the invention. Expression may also refer to translation of mRNA into a polypeptide.

As used herein, "transformation" refers to the transfer of a nucleic acid molecule into the genome of a host organism, resulting in genetically stable inheritance. In the present invention, the host cell's genome includes chromosomal and extrachromosomal (e.g., plasmid) genes. Host organisms containing the transformed nucleic acid molecules are referred to as "transgenic", "recombinant" or "transformed" organisms.

As used herein, the term "sequence analysis software" refers to any computer algorithm or software program that is useful for the analysis of nucleotide or amino acid sequences. "Sequence analysis software" may be commercially available or independently developed. Typical sequence analysis software will include, but is not limited to, the GCG suite of programs (Wisconsin Package Version 9.0, Accelrys Software Corp., San Diego, Calif.), BLASTP, BLASTN, BLASTX (Altschul et al., *J. Mol. Biol.* 215:403-410 (1990)), and DNASTAR (DNASTAR, Inc. 1228 S. Park St. Madison, Wis. 53715 USA), CLUSTALW (for example, version 1.83; Thompson et al., *Nucleic Acids Research,* 22(22):4673-4680 (1994)), and the FASTA program incorporating the Smith-Waterman algorithm (W. R. Pearson, *Comput. Methods Genome Res.,* [Proc. Int. Symp.] (1994), Meeting Date 1992, 111-20. Editor(s): Suhai, Sandor. Publisher: Plenum, New York, N.Y.), Vector NTI (Informax, Bethesda, Md.) and Sequencher v. 4.05. Within the context of this application it will be understood that where sequence analysis software is used for analysis, that the results of the analysis will be based on the "default values" of the program referenced, unless otherwise specified. As used herein "default values" will mean any set of values or parameters set by the software manufacturer that originally load with the software when first initialized.

Structural and Functional Properties of the Present Soluble α-Glucan Fiber Composition Human gastrointestinal enzymes readily recognize and digest linear α-glucan oligomers having a substantial amount of α-(1,4) glycosidic bonds. Replacing these linkages with alternative linkages such as α-(1,2), α-(1,3), and α-(1,6) typically reduces the digestibility of the α-glucan oligomers. Increasing the degree of branching (using the alternative linkages) may also reduce the relative level of digestibility.

The present soluble α-glucan fiber composition (comprising α-(1,2) branching) was prepared using cane sugar (sucrose) and a suitable α-glucan substrate backbone using one or more enzymatic processing aids that have essentially the same amino acid sequences as found in nature (or active truncations thereof) from microorganisms which having a long history of exposure to humans (microorganisms naturally found in the oral cavity or found in foods such a beer, fermented soybeans, etc.) and/or those that are generally recognized as safe (GRAS). The soluble fibers have slow to no digestibility, exhibit high tolerance (i.e., as measured by an acceptable amount of gas formation), low viscosity (enabling use in a broad range of food applications), and are at least partially fermentable by gut microflora, providing possible prebiotic effects (for example, increasing the number and/or activity of bifidobacteria and lactic acid bacteria reported to be associated with providing potential prebiotic effects).

The α-glucan substrate backbone suitable for use with the present polypeptides having α-(1,2) branching activity can be synthesized from sucrose, maltodextrin, or a combination thereof depending upon the enzymes selected. The enzymes used to prepare the α-glucan substrate backbone suitable for the α-(1,2) branching reaction may include glucosyltransferases (using sucrose), 4,6-α-glucanohydrolases (using maltodextrin/maltooligosaccharides), dextrin dextranases (using maltodextrin/maltooligosaccharides), each of which may be used alone or in combination with one or more α-glucanohydrolases (e.g., dextranases, mutanases, etc.). The maltodextrin/maltooligosaccharides may be prepared from processed starched or may be synthesized from sucrose using an amylosucrase.

The present soluble α-glucan fiber composition is characterized by the following combination of parameters:
a. a range of:
  a) 0% to 50% of α-(1,3) glycosidic linkages; or
  b) 0% to 40% α-(1,4) glycosidic linkages; or
  c) any combination of a) and b);

b. 1 to 50% of a combination of α-(1,2) and α-(1,2,6) glycosidic linkages;
c. 0-25% α-(1,3,6) glycosidic linkages;
d. less than 99% α-(1,6) glycosidic linkages;
e. a weight average molecular weight of less than 300 kDa;
f. a viscosity of less than 0.25 Pascal second (Pa·s) at 12 wt % in water at 20° C.;
g. a digestibility of less than 20% as measured by the Association of Analytical Communities (AOAC) method 2009.01;
h. a solubility of at least 20% (w/w) in pH 7 water at 25° C.; and
i. a polydispersity index of less than 26, preferably less than 5.

In one embodiment, the soluble α-glucan fiber composition as described above, wherein the sum of the α-(1,3) and α-(1,3,6) glycosidic linkages content ranges from 3% to 50%, preferably 3% to 25%.

In another embodiment, the soluble α-glucan fiber composition as described above comprises 15-35%; preferably 20-30% α-(1,4) glycosidic linkages.

In another embodiment, the soluble α-glucan fiber composition comprises 1% to 40%, preferably 2% to 30% of a combination of α-(1,2) and α-(1,2,6) glycosidic linkages.

In another embodiment, in addition to the above mentioned glycosidic linkage content embodiments, the present α-glucan fiber composition comprises a weight average molecular weight ($M_w$) of less than 300000 Daltons (Da), preferably 1500 to 300000 Da, more preferably 1500 to 90,000 Da, more preferably 1500 to 20,000 Da, and even more preferably 1500 to 16,000 Da.

In one preferred embodiment, the above soluble α-glucan fiber composition comprises 95 to 98% α-(1,6) glycosidic linkages, 2 to 5% of a combination of α-(1,2) and α-(1,2,6) glycosidic linkages, and comprises a weight average molecular weight greater than 10,000 Da; preferably greater than 10,000 Da but less than 20,000 Da.

In another embodiment, in addition to any of the above features, the present α-glucan fiber composition comprises a viscosity of less than 250 centipoise (cP) (0.25 Pascal second (Pa·s)), preferably less than 10 centipoise (cP) (0.01 Pascal second (Pa·s)), preferably less than 7 cP (0.007 Pa·s), more preferably less than 5 cP (0.005 Pa·s), more preferably less than 4 cP (0.004 Pa·s), and most preferably less than 3 cP (0.003 Pa·s) at 12 wt % in water at 20° C.

The present soluble α-glucan composition has a digestibility of less than 20%, preferably less than 15%, 10%, 9%, 8%, 7%, 6%, 5%, 4%, 3%, 2% or 1% digestible as measured by the Association of Analytical Communities (AOAC) method 2009.01.

In addition to any of the above embodiments, the present soluble α-glucan fiber composition has a solubility of at least 20% (w/w), preferably at least 30%, 40%, 50%, 60%, or 70% in pH 7 water at 25° C.

In one embodiment, the present soluble α-glucan fiber composition comprises a reducing sugar content of less than 10 wt %, preferably less than 5 wt %, and most preferably 1 wt % or less.

In another embodiment, the present soluble α-glucan fiber composition comprises a number average molecular weight (Mn) between 1500 and 90,000 g/mol, preferably 1500 to 30,000 g/mol, more preferably 1500 to 20,000, and more preferably 3000 to 16000 g/mol. In one embodiment, the number average molecular weight (Mn) is between 13000 and 16000.

In one embodiment, the present soluble α-glucan fiber composition comprises a caloric content of less than 4 kcal/g, preferably less than 3 kcal/g, more preferably less than 2.5 kcal/g, and most preferably about 2 kcal/g or less.

Compositions Comprising Glucan Fibers

Depending upon the desired application, the present glucan fibers/fiber composition may be formulated (e.g., blended, mixed, incorporated into, etc.) with one or more other materials suitable for use in foods, personal care products and/or pharmaceuticals. As such, the present invention includes compositions comprising the present glucan fiber composition. The term "compositions comprising the present glucan fiber composition" in this context may include, for example, a nutritional or food composition, such as food products, food supplements, or functional foods. In a further embodiment, "compositions comprising the present glucan fiber composition" may also include personal care products, cosmetics, and pharmaceuticals.

The present glucan fibers/fiber composition may be directed as an ingredient in a desired product (e.g., foods, personal care products, etc.) or may be blended with one or more additional food grade materials to form a carbohydrate composition that is used in the desired product (e.g., foods, personal care products, etc.). The amount of the α-glucan fiber composition incorporated into the carbohydrate composition may vary according to the application. As such, the present invention comprises a carbohydrate composition comprising the present soluble α-glucan fiber composition. In one embodiment, the carbohydrate composition comprises 0.01 to 99 wt % (dry solids basis), preferably 0.1 to 90 wt %, more preferably 1 to 90%, and most preferably 5 to 80 wt % of the soluble glucan fiber composition described above.

The term "food" as used herein is intended to encompass food for human consumption as well as for animal consumption. By "functional food" it is meant any fresh or processed food claimed to have a health-promoting and/or disease-preventing and/or disease-reducing property beyond the basic nutritional function of supplying nutrients. Functional food may include, for example, processed food or foods fortified with health-promoting additives. Examples of functional food are foods fortified with vitamins, or fermented foods with live cultures.

The carbohydrate composition comprising the present soluble α-glucan fiber composition may contain other materials known in the art for inclusion in nutritional compositions, such as water or other aqueous solutions, fats, sugars, starch, binders, thickeners, colorants, flavorants, odorants, acidulants (such as lactic acid or malic acid, among others), stabilizers, or high intensity sweeteners, or minerals, among others. Examples of suitable food products include bread, breakfast cereals, biscuits, cakes, cookies, crackers, yogurt, kefir, miso, natto, tempeh, kimchee, sauerkraut, water, milk, fruit juice, vegetable juice, carbonated soft drinks, non-carbonated soft drinks, coffee, tea, beer, wine, liquor, alcoholic drink, snacks, soups, frozen desserts, fried foods, pizza, pasta products, potato products, rice products, corn products, wheat products, dairy products, hard candies, nutritional bars, cereals, dough, processed meats and cheeses, yoghurts, ice cream confections, milk-based drinks, salad dressings, sauces, toppings, desserts, confectionery products, cereal-based snack bars, prepared dishes, and the like. The carbohydrate composition comprising the present α-glucan fiber may be in the form of a liquid, a syrup, a powder, granules, shaped spheres, shaped sticks, shaped plates, shaped cubes, tablets, capsules, sachets, or any combination thereof.

In one embodiment, the carbohydrate composition according to the invention may comprise at least two fiber sources (i.e., at least one additional fiber source beyond the present α-glucan fiber composition). In another embodiment, one fiber source is the present glucan fiber and the second fiber source is an oligo- or polysaccharide, selected from the group consisting of resistant/branched maltodextrins/fiber dextrins (such as NUTRIOSE® from Roquette Freres, Lestrem, France; FIBERSOL-2® from ADM-Matsutani LLC, Decatur, Ill.), polydextrose (LITESSE® from Danisco—DuPont Nutrition & Health, Wilmington, Del.), soluble corn fiber (for example, PROMITOR® from Tate & Lyle, London, UK), isomaltooligosaccharides (IMOs), alternan and/or maltoalternan oligosaccharides (MAOs) (for example, FIBERMALT™ from Aevotis GmbH, Potsdam, Germany; SUCROMALT™ (from Cargill Inc., Minneapolis, Minn.), pullulan, resistant starch, inulin, fructooligosaccharides (FOS), galactooligosaccharides (GOS), xylooligosaccharides, arabinoxylooligosaccharides, nigerooligosaccharides, gentiooligosaccharides, hem icellulose and fructose oligomer syrup.

The present soluble α-glucan fiber can be added to foods as a replacement or supplement for conventional carbohydrates. As such, another embodiment of the invention is a food product comprising the present soluble α-glucan fiber. In another aspect, the food product comprises the soluble α-glucan fiber composition produced by the present process.

The soluble α-glucan fiber composition may be used in a carbohydrate composition and/or food product comprising one or more high intensity artificial sweeteners including, but not limited to stevia, aspartame, sucralose, neotame, acesulfame potassium, saccharin, and combinations thereof. The present soluble α-glucan fiber may be blended with sugar substitutes such as brazzein, curculin, erythritol, glycerol, glycyrrhizin, hydrogenated starch hydrolysates, inulin, isomalt, lactitol, mabinlin, maltitol, maltooligosaccharide, maltoalternan oligosaccharides (such as XTEND® SUCROMALT™, available from Cargill Inc., Minneapolis, Minn.), mannitol, miraculin, a mogroside mix, monatin, monellin, osladin, pentadin, sorbitol, stevia, tagatose, thaumatin, xylitol, and any combination thereof.

A food product containing the soluble α-glucan fiber composition will have a lower glycemic response, lower glycemic index, and lower glycemic load than a similar food product in which a conventional carbohydrate is used. Further, because the soluble α-glucan fiber is characterized by very low to no digestibility in the human stomach or small intestine, the caloric content of the food product is reduced. The present soluble α-glucan fiber may be used in the form of a powder, blended into a dry powder with other suitable food ingredients or may be blended or used in the form of a liquid syrup comprising the present dietary fiber (also referred to herein as an "soluble fiber syrup", "fiber syrup" or simply the "syrup"). The "syrup" can be added to food products as a source of soluble fiber. It can increase the fiber content of food products without having a negative impact on flavor, mouth feel, or texture.

The fiber syrup can be used in food products alone or in combination with bulking agents, such as sugar alcohols or maltodextrins, to reduce caloric content and/or to enhance nutritional profile of the product. The fiber syrup can also be used as a partial replacement for fat in food products.

The fiber syrup can be used in food products as a tenderizer or texturizer, to increase crispness or snap, to improve eye appeal, and/or to improve the rheology of dough, batter, or other food compositions. The fiber syrup can also be used in food products as a humectant, to increase product shelf life, and/or to produce a softer, moister texture. It can also be used in food products to reduce water activity or to immobilize and manage water. Additional uses of the fiber syrup may include: replacement of an egg wash and/or to enhance the surface sheen of a food product, to alter flour starch gelatinization temperature, to modify the texture of the product, and to enhance browning of the product.

The fiber syrup can be used in a variety of types of food products. One type of food product in which the present syrup can be very useful is bakery products (i.e., baked foods), such as cakes, brownies, cookies, cookie crisps, muffins, breads, and sweet doughs. Conventional bakery products can be relatively high in sugar and high in total carbohydrates. The use of the present syrup as an ingredient in bakery products can help lower the sugar and carbohydrate levels, as well as reduce the total calories, while increasing the fiber content of the bakery product.

There are two main categories of bakery products: yeast-raised and chemically-leavened. In yeast-raised products, like donuts, sweet doughs, and breads, the present fiber-containing syrup can be used to replace sugars, but a small amount of sugar may still be desired due to the need for a fermentation substrate for the yeast or for crust browning. The fiber syrup can be added with other liquids as a direct replacement for non-fiber containing syrups or liquid sweeteners. The dough would then be processed under conditions commonly used in the baking industry including being mixed, fermented, divided, formed or extruded into loaves or shapes, proofed, and baked or fried. The product can be baked or fried using conditions similar to traditional products. Breads are commonly baked at temperatures ranging from 420° F. to 520° F. (216-271° C.). for 20 to 23 minutes and doughnuts can be fried at temperatures ranging from 400-415° F. (204-213° C.), although other temperatures and times could also be used.

Chemically leavened products typically have more sugar and may contain have a higher level of the carbohydrate compositions and/or edible syrups comprising the present soluble α-glucan fiber. A finished cookie can contain 30% sugar, which could be replaced, entirely or partially, with carbohydrate compositions and/or syrups comprising the present glucan fiber composition. These products could have a pH of 4-9.5, for example. The moisture content can be between 2-40%, for example.

The present carbohydrate compositions and/or fiber-containing syrups are readily incorporated and may be added to the fat at the beginning of mixing during a creaming step or in any method similar to the syrup or dry sweetener that it is being used to replace. The product would be mixed and then formed, for example by being sheeted, rotary cut, wire cut, or through another forming process. The products would then be baked under typical baking conditions, for example at 200-450° F. (93-232° C.).

Another type of food product in which the carbohydrate compositions and/or fiber-containing syrups can be used is breakfast cereal. For example, fiber-containing syrups could be used to replace all or part of the sugar in extruded cereal pieces and/or in the coating on the outside of those pieces. The coating is typically 30-60% of the total weight of the finished cereal piece. The syrup can be applied in a spray or drizzled on, for example.

Another type of food product in which the present α-glucan fiber composition (optionally used in the form of a carbohydrate composition and/or fiber-containing syrup) can be used is dairy products. Examples of dairy products in which it can be used include yogurt, yogurt drinks, milk drinks, flavored milks, smoothies, ice cream, shakes, cottage cheese, cottage cheese dressing, and dairy desserts, such as quarg and the whipped mousse-type products. This would include dairy products that are intended to be consumed directly (such as packaged smoothies) as well as those that are intended to be blended with other ingredients (such as blended smoothies). It can be used in pasteurized dairy products, such as ones that are pasteurized at a temperature from 160° F. to 285° F. (71-141° C.).

Another type of food product in which the composition comprising the α-glucan fiber composition can be used is confections. Examples of confections in which it can be used include hard candies, fondants, nougats and marshmallows, gelatin jelly candies or gummies, jellies, chocolate, licorice, chewing gum, caramels and toffees, chews, mints, tabletted confections, and fruit snacks. In fruit snacks, a composition comprising the present α-glucan fiber could be used in combination with fruit juice. The fruit juice would provide the majority of the sweetness, and the composition comprising the glucan fiber would reduce the total sugar content and add fiber. The present compositions comprising the glucan fiber can be added to the initial candy slurry and heated to the finished solids content. The slurry could be heated from 200-305° F. (93-152° C.). to achieve the finished solids content. Acid could be added before or after heating to give a finished pH of 2-7. The composition comprising the glucan fiber could be used as a replacement for 0-100% of the sugar and 1-100% of the corn syrup or other sweeteners present.

Another type of food product in which a composition comprising the α-glucan fiber composition can be used is jams and jellies. Jams and jellies are made from fruit. A jam contains fruit pieces, while jelly is made from fruit juice. The composition comprising the present fiber can be used in place of sugar or other sweeteners as follows: weigh fruit and juice into a tank; premix sugar, the fiber-containing composition and pectin; add the dry composition to the liquid and cook to a temperature of 214-220° F. (101-104° C.); hot fill into jars and retort for 5-30 minutes.

Another type of food product in which a composition comprising the present α-glucan fiber composition (such as a fiber-containing syrup) can be used is beverages. Examples of beverages in which it can be used include carbonated beverages, fruit juices, concentrated juice mixes (e.g., margarita mix), clear waters, and beverage dry mixes. The use of the present α-glucan fiber may overcome the clarity problems that result when other types of fiber are added to beverages. A complete replacement of sugars may be possible (which could be, for example, being up to 12% or more of the total formula).

Another type of food product is high solids fillings. Examples of high solids fillings include fillings in snack bars, toaster pastries, donuts, and cookies. The high solids filling could be an acid/fruit filling or a savory filling, for example. The fiber composition could be added to products that would be consumed as is, or products that would undergo further processing, by a food processor (additional baking) or by a consumer (bake stable filling). In some embodiments of the invention, the high solids fillings would have a solids concentration between 67-90%. The solids could be entirely replaced with a composition comprising the present α-glucan fiber or it could be used for a partial replacement of the other sweetener solids present (e.g., replacement of current solids from 5-100%). Typically fruit fillings would have a pH of 2-6, while savory fillings would be between 4-8 pH. Fillings could be prepared cold or heated at up to 250° F. (121° C.) to evaporate to the desired finished solids content.

Another type of food product in which the α-glucan fiber composition or a carbohydrate composition (comprising the α-glucan fiber composition) can be used is extruded and sheeted snacks. Examples of extruded and sheeted can be used include puffed snacks, crackers, tortilla chips, and corn chips. In preparing an extruded piece, a composition comprising the present glucan fiber would be added directly with the dry products. A small amount of water would be added in the extruder, and then it would pass through various zones ranging from 100° F. to 300° F. (38-149° C.). The dried product could be added at levels from 0-50% of the dry products mixture. A syrup comprising the present glucan fiber could also be added at one of the liquid ports along the extruder. The product would come out at either a low moisture content (5%) and then baked to remove the excess moisture, or at a slightly higher moisture content (10%) and then fried to remove moisture and cook out the product. Baking could be at temperatures up to 500° F. (260° C.). for 20 minutes. Baking would more typically be at 350° F. (177° C.) for 10 minutes. Frying would typically be at 350° F. (177° C.) for 2-5 minutes. In a sheeted snack, the composition comprising the present glucan fiber could be used as a partial replacement of the other dry ingredients (for example, flour). It could be from 0-50% of the dry weight. The product would be dry mixed, and then water added to form cohesive dough. The product mix could have a pH from 5 to 8. The dough would then be sheeted and cut and then baked or fried. Baking could be at temperatures up to 500° F. (260° C.) for 20 minutes. Frying would typically be at 350° F. (177° C.) for 2-5 minutes. Another potential benefit from the use of a composition comprising the present glucan fiber is a reduction of the fat content of fried snacks by as much as 15% when it is added as an internal ingredient or as a coating on the outside of a fried food.

Another type of food product in which a fiber-containing syrup can be used is gelatin desserts. The ingredients for gelatin desserts are often sold as a dry mix with gelatin as a gelling agent. The sugar solids could be replaced partially or entirely with a composition comprising the present glucan fiber in the dry mix. The dry mix can then be mixed with water and heated to 212° F. (100° C.). to dissolve the gelatin and then more water and/or fruit can be added to complete the gelatin dessert. The gelatin is then allowed to cool and set. Gelatin can also be sold in shelf stable packs. In that case the stabilizer is usually carrageenan-based. As stated above, a composition comprising the present glucan fiber could be used to replace up to 100% of the other sweetener solids. The dry ingredients are mixed into the liquids and then pasteurized and put into cups and allowed to cool and set.

Another type of food product in which a composition comprising the present glucan fiber can be used is snack bars. Examples of snack bars in which it can be used include breakfast and meal replacement bars, nutrition bars, granola bars, protein bars, and cereal bars. It could be used in any part of the snack bars, such as in the high solids filling, the binding syrup or the particulate portion. A complete or partial replacement of sugar in the binding syrup may be possible. The binding syrup is typically from 50-90% solids and applied at a ratio ranging from 10% binding syrup to 90% particulates, to 70% binding syrup to 30% particulates. The binding syrup is made by heating a solution of sweeteners, bulking agents and other binders (like starch) to 160-230° F. (71-110° C.) (depending on the finished solids needed in the syrup). The syrup is then mixed with the particulates to coat the particulates, providing a coating throughout the matrix. A composition comprising the present glucan fiber could also be used in the particulates themselves. This could be an extruded piece, directly expanded or gun puffed. It could be used in combination with another grain ingredient, corn meal, rice flour or other similar ingredient.

Another type of food product in which the composition comprising the present glucan fiber syrup can be used is cheese, cheese sauces, and other cheese products. Examples of cheese, cheese sauces, and other cheese products in which it can be used include lower milk solids cheese, lower fat cheese, and calorie reduced cheese. In block cheese, it can help to improve the melting characteristics, or to decrease the effect of the melt limitation added by other ingredients such as starch. It could also be used in cheese sauces, for example as a bulking agent, to replace fat, milk solids, or other typical bulking agents.

Another type of food product in which a composition comprising the present glucan fiber can be used is films that are edible and/or water soluble. Examples of films in which it can be used include films that are used to enclose dry mixes for a variety of foods and beverages that are intended to be dissolved in water, or films that are used to deliver color or flavors such as a spice film that is added to a food after cooking while still hot. Other film applications include, but are not limited to, fruit and vegetable leathers, and other flexible films.

In another embodiment, compositions comprising the present glucan fiber can be used is soups, syrups, sauces, and dressings. A typical dressing could be from 0-50% oil, with a pH range of 2-7. It could be cold processed or heat processed. It would be mixed, and then stabilizer would be added. The composition comprising the present glucan fiber could easily be added in liquid or dry form with the other ingredients as needed. The dressing composition may need to be heated to activate the stabilizer. Typical heating conditions would be from 170-200° F. (77-93° C.) for 1-30 minutes. After cooling, the oil is added to make a pre-emulsion. The product is then emulsified using a homogenizer, colloid mill, or other high shear process.

Sauces can have from 0-10% oil and from 10-50% total solids, and can have a pH from 2-8. Sauces can be cold processed or heat processed. The ingredients are mixed and then heat processed. The composition comprising the present glucan fiber could easily be added in liquid or dry form with the other ingredients as needed. Typical heating would be from 170-200° F. (77-93° C.) for 1-30 minutes.

Soups are more typically 20-50% solids and in a more neutral pH range (4-8). They can be a dry mix, to which a dry composition comprising the present glucan fiber could be added, or a liquid soup which is canned and then retorted. In soups, resistant corn syrup could be used up to 50% solids, though a more typical usage would be to deliver 5 g of fiber/serving.

Another type of food product in which a composition comprising the present α-glucan fiber composition can be used is coffee creamers. Examples of coffee creamers in which it can be used include both liquid and dry creamers. A dry blended coffee creamer can be blended with commercial creamer powders of the following fat types: soybean, coconut, palm, sunflower, or canola oil, or butterfat. These fats can be non-hydrogenated or hydrogenated. The composition comprising the present α-glucan fiber composition can be added as a fiber source, optionally together with fructo-oligosaccharides, polydextrose, inulin, maltodextrin, resistant starch, sucrose, and/or conventional corn syrup solids. The composition can also contain high intensity sweeteners, such as sucralose, acesulfame potassium, aspartame, or combinations thereof. These ingredients can be dry blended to produce the desired composition.

A spray dried creamer powder is a combination of fat, protein and carbohydrates, emulsifiers, emulsifying salts, sweeteners, and anti-caking agents. The fat source can be one or more of soybean, coconut, palm, sunflower, or canola oil, or butterfat. The protein can be sodium or calcium caseinates, milk proteins, whey proteins, wheat proteins, or soy proteins. The carbohydrate could be a composition comprising the present α-glucan fiber composition alone or in combination with fructooligosaccharides, polydextrose, inulin, resistant starch, maltodextrin, sucrose, corn syrup or any combination thereof. The emulsifiers can be mono- and diglycerides, acetylated mono- and diglycerides, or propylene glycol monoesters. The salts can be trisodium citrate, monosodium phosphate, disodium phosphate, trisodium phosphate, tetrasodium pyrophosphate, monopotassium phosphate, and/or dipotassium phosphate. The composition can also contain high intensity sweeteners, such as those describe above. Suitable anti-caking agents include sodium silicoaluminates or silica dioxides. The products are combined in slurry, optionally homogenized, and spray dried in either a granular or agglomerated form.

Liquid coffee creamers are simply a homogenized and pasteurized emulsion of fat (either dairy fat or hydrogenated vegetable oil), some milk solids or caseinates, corn syrup, and vanilla or other flavors, as well as a stabilizing blend. The product is usually pasteurized via HTST (high temperature short time) at 185° F. (85° C.) for 30 seconds, or UHT (ultra-high temperature), at 285° F. (141° C.) for 4 seconds, and homogenized in a two stage homogenizer at 500-3000 psi (3.45-20.7 MPa) first stage, and 200-1000 psi (1.38-6.89 MPa) second stage. The coffee creamer is usually stabilized so that it does not break down when added to the coffee.

Another type of food product in which a composition comprising the present α-glucan fiber composition (such as a fiber-containing syrup) can be used is food coatings such as icings, frostings, and glazes. In icings and frostings, the fiber-containing syrup can be used as a sweetener replacement (complete or partial) to lower caloric content and increase fiber content. Glazes are typically about 70-90% sugar, with most of the rest being water, and the fiber-containing syrup can be used to entirely or partially replace the sugar. Frosting typically contains about 2-40% of a liquid/solid fat combination, about 20-75% sweetener solids, color, flavor, and water. The fiber-containing syrup can be used to replace all or part of the sweetener solids, or as a bulking agent in lower fat systems.

Another type of food product in which the fiber-containing syrup can be used is pet food, such as dry or moist dog food. Pet foods are made in a variety of ways, such as extrusion, forming, and formulating as gravies. The fiber-containing syrup could be used at levels of 0-50% in each of these types.

Another type of food product in which a composition comprising the present α-glucan fiber composition, such as a syrup, can be used is fish and meat. Conventional corn syrup is already used in some meats, so a fiber-containing syrup can be used as a partial or complete substitute. For example, the syrup could be added to brine before it is vacuum tumbled or injected into the meat. It could be added with salt and phosphates, and optionally with water binding ingredients such as starch, carrageenan, or soy proteins. This would be used to add fiber, a typical level would be 5 g/serving which would allow a claim of excellent source of fiber.

Personal Care and/or Pharmaceutical Compositions Comprising the Present Soluble Fiber The present glucan fiber and/or compositions comprising the present glucan fiber may be used in personal care products. For example, one may be able to use such materials as a humectants, hydrocolloids or possibly thickening agents. The present fibers and/or compositions comprising the present fibers may be used in conjunction with one or more other types of thickening agents if desired, such as those disclosed in U.S. Pat. No. 8,541,041, the disclosure of which is incorporated herein by reference in its entirety.

Personal care products herein are not particularly limited and include, for example, skin care compositions, cosmetic compositions, antifungal compositions, and antibacterial compositions. Personal care products herein may be in the form of, for example, lotions, creams, pastes, balms, ointments, pomades, gels, liquids, combinations of these and the like. The personal care products disclosed herein can include at least one active ingredient. An active ingredient is generally recognized as an ingredient that produces an intended pharmacological or cosmetic effect.

In certain embodiments, a skin care product can be applied to skin for addressing skin damage related to a lack of moisture. A skin care product may also be used to address the visual appearance of skin (e.g., reduce the appearance of flaky, cracked, and/or red skin) and/or the tactile feel of the skin (e.g., reduce roughness and/or dryness of the skin while improved the softness and subtleness of the skin). A skin care product typically may include at least one active ingredient for the treatment or prevention of skin ailments, providing a cosmetic effect, or for providing a moisturizing benefit to skin, such as zinc oxide, petrolatum, white petrolatum, mineral oil, cod liver oil, lanolin, dimethicone, hard fat, vitamin A, allantoin, calamine, kaolin, glycerin, or colloidal oatmeal, and combinations of these. A skin care product may include one or more natural moisturizing factors such as ceramides, hyaluronic acid, glycerin, squalane, amino acids, cholesterol, fatty acids, triglycerides, phospholipids, glycosphingolipids, urea, linoleic acid, glycosaminoglycans, mucopolysaccharide, sodium lactate, or sodium pyrrolidone carboxylate, for example. Other ingredients that may be included in a skin care product include, without limitation, glycerides, apricot kernel oil, canola oil, squalane, squalene, coconut oil, corn oil, jojoba oil, jojoba wax, lecithin, olive oil, safflower oil, sesame oil, shea butter, soybean oil, sweet almond oil, sunflower oil, tea tree oil, shea butter, palm oil, cholesterol, cholesterol esters, wax esters, fatty acids, and orange oil.

A personal care product herein can also be in the form of makeup or other product including, but not limited to, a lipstick, mascara, rouge, foundation, blush, eyeliner, lip liner, lip gloss, other cosmetics, sunscreen, sun block, nail polish, mousse, hair spray, styling gel, nail conditioner, bath gel, shower gel, body wash, face wash, shampoo, hair conditioner (leave-in or rinse-out), cream rinse, hair dye, hair coloring product, hair shine product, hair serum, hair anti-frizz product, hair split-end repair product, lip balm, skin conditioner, cold cream, moisturizer, body spray, soap, body scrub, exfoliant, astringent, scruffing lotion, depilatory, permanent waving solution, antidandruff formulation, antiperspirant composition, deodorant, shaving product, pre-shaving product, after-shaving product, cleanser, skin gel, rinse, toothpaste, or mouthwash, for example.

A pharmaceutical product herein can be in the form of an emulsion, liquid, elixir, gel, suspension, solution, cream, capsule, tablet, sachet or ointment, for example. Also, a pharmaceutical product herein can be in the form of any of the personal care products disclosed herein. A pharmaceutical product can further comprise one or more pharmaceutically acceptable carriers, diluents, and/or pharmaceutically acceptable salts. The present fibers and/or compositions comprising the present fibers can also be used in capsules, encapsulants, tablet coatings, and as an excipients for medicaments and drugs.

Gas Production

A rapid rate of gas production in the lower gastrointestinal tract gives rise to gastrointestinal discomfort such as flatulence and bloating, whereas if gas production is gradual and low the body can more easily cope. For example, inulin gives a boost of gas production which is rapid and high when compared to the present glucan fiber composition at an equivalent dosage (grams soluble fiber), whereas the present glucan fiber composition preferable preferably has a rate of gas release that is lower than that of inulin at an equivalent dosage.

In one embodiment, the soluble $\alpha$-glucan fiber composition of the invention comprises a rate of gas production that is well tolerated for food applications. In one embodiment, the relative rate of gas production is no more than the rate observed for inulin under similar conditions, preferably the same or less than inulin, more preferably less than inulin, and most preferably much less than inulin at an equivalent dosage. In another embodiment, the relative rate of gas formation is measured over 3 hours or 24 hours using the methods described herein. In a preferred aspect, the rate of gas formulation formation is at least 1%, preferably 2%, 3%, 4%, 5%, 6%, 7%, 8%, 9%, 10%, 15%, 20%, 25% or at least 30% less than the rate observed for inulin under the same reaction conditions.

Beneficial Physiological Properties

Short Chain Fatty Acid Production

Use of the compounds according to the present invention may facilitate the production of energy yielding metabolites through colonic fermentation. Use of compounds according to the invention may facilitate the production of short chain fatty acids, such as propionate and/or butyrate. SCFAs are known to lower cholesterol. Consequently, the compounds of the invention may lower the risk of developing high cholesterol. The present glucan fiber composition may stimulate the production of short chain fatty acids, especially proprionate and/or butyrate, in fermentation studies. As the production of short chain fatty acids (SCFA) or the increased ratio of SCFA to acetate is beneficial for the control of cholesterol levels in a mammal in need thereof, the current invention may be of particular interest to nutritionists and consumers for the prevention and/or treatment of cardiovascular risks. Thus, another aspect of the invention provides a method for improving the health of a subject comprising administering a composition comprising the present $\alpha$-glucan fiber composition to a subject in an effective amount to exert a beneficial effect on the health of said subject, such as for treating cholesterol-related diseases. In addition, it is generally known that short chain fatty acids lower the pH in the gut and this helps calcium absorption. Thus, compounds according to the present invention may also affect mineral absorption. This means that they may also improve bone health, or prevent or treat osteoporosis by lowering the pH due to SCFA increases in the gut. The production of SCFA may increase viscosity in small intestine which reduces the re-absorption of bile acids; increasing the synthesis of bile acids from cholesterol and reduces circulating low density lipoprotein (LDL) cholesterol.

In terms of beneficial physiological effect, an effective amount of a compound or composition refers to an amount effective, at dosages and for periods of time necessary, to achieve a desired beneficial physiological effect, such as lowering of blood cholesterol, increasing short chain fatty acid production or preventing or treating a gastrointestinal disorder. For instance, the amount of a composition administered to a subject will vary depending upon factors such as the subject's condition, the subject's body weight, the age of the subject, and whether a composition is the sole source of nutrition. The effective amount may be readily set by a medical practitioner or dietician. In general, a sufficient amount of the composition is administered to provide the subject with up to about 50 g of dietary fiber (insoluble and soluble) per day; for example about 25 g to about 35 g of dietary fiber per day. The amount of the present soluble α-glucan fiber composition that the subject receives is preferably in the range of about 0.1 g to about 50 g per day, more preferably in the rate of 0.5 g to 20 g per day, and most preferably 1 to 10 g per day. A compound or composition as defined herein may be taken in multiple doses, for example 1 to 5 times, spread out over the day or acutely, or may be taken in a single dose. A compound or composition as defined herein may also be fed continuously over a desired period. In certain embodiments, the desired period is at least one week or at least two weeks or at least three weeks or at least one month or at least six months.

In a preferred embodiment, the present invention provides a method for decreasing blood triglyceride levels in a subject in need thereof by administering a compound or a composition as defined herein to a subject in need thereof. In another preferred embodiment, the invention provides a method for decreasing low density lipoprotein levels in a subject in need thereof by administering a compound or a composition as defined herein to a subject in need thereof. In another preferred embodiment, the invention provides a method for increasing high density lipoprotein levels in a subject in need thereof by administering a compound or a composition as defined herein to a subject in need thereof.

Attenuation of Postprandial Blood Glucose Concentrations/Glycemic Response

The presence of bonds other than α-(1,4) backbone linkages in the present α-glucan fiber composition provides improved digestion resistance as enzymes of the human digestion track may have difficultly hydrolyzing such bonds and/or branched linkages. The presence of branches provides partial or complete indigestibility to glucan fibers, and therefore virtually no or a slower absorption of glucose into the body, which results in a lower glycemic response. Accordingly, the present invention provides an α-glucan fiber composition for the manufacture of food and drink compositions resulting in a lower glycemic response. For example, these compounds can be used to replace sugar or other rapidly digestible carbohydrates, and thereby lower the glycemic load of foods, reduce calories, and/or lower the energy density of foods. Also, the stability of the present α-glucan fiber composition possessing these types of bonds allows them to be easily passed through into the large intestine where they may serve as a substrate specific for the colonic microbial flora.

Improvement of Gut Health

In a further embodiment, compounds of the present invention may be used for the treatment and/or improvement of gut health. The present α-glucan fiber composition is preferably slowly fermented in the gut by the gut microflora. Preferably, the present compounds exhibit in an in vitro gut model a tolerance no worse than inulin or other commercially available fibers such as PROMITOR® (soluble corn fiber, Tate & Lyle), NUTRIOSE® (soluble corn fiber or resistant dextrin, Roquette), or FIBERSOL®-2 (digestion-resistant maltodextrin, Archer Daniels Midland Company & Matsutani Chemical), (i.e., a similar level of gas production), preferably an improved tolerance over one or more of the commercially available fibers, i.e. the fermentation of the present glucan fiber results in less gas production than inulin in 3 hours or 24 hours, thereby lowering discomfort, such as flatulence and bloating, due to gas formation. In one aspect, the present invention also relates to a method for moderating gas formation in the gastrointestinal tract of a subject by administering a compound or a composition as defined herein to a subject in need thereof, so as to decrease gut pain or gut discomfort due to flatulence and bloating. In further embodiments, compositions of the present invention provide subjects with improved tolerance to food fermentation, and may be combined with fibers, such as inulin or FOS, GOS, or lactulose to improve tolerance by lowering gas production.

In another embodiment, compounds of the present invention may be administered to improve laxation or improve regularity by increasing stool bulk.

Prebiotics and Probiotics

The soluble α-glucan fiber composition(s) may be useful as prebiotics, or as "synbiotics" when used in combination with probiotics, as discussed below. By "prebiotic" it is meant a food ingredient that beneficially affects the subject by selectively stimulating the growth and/or activity of one or a limited number of bacteria in the gastrointestinal tract, particularly the colon, and thus improves the health of the host. Examples of prebiotics include fructooligosaccharides, inulin, polydextrose, resistant starch, soluble corn fiber, glucooligosaccharides and galactooligosaccharides, arabinoxylan-oligosaccharides, lactitol, and lactulose.

In another embodiment, compositions comprising the soluble α-glucan fiber composition further comprise at least one probiotic organism. By "probiotic organism" it is meant living microbiological dietary supplements that provide beneficial effects to the subject through their function in the digestive tract. In order to be effective the probiotic microorganisms must be able to survive the digestive conditions, and they must be able to colonize the gastrointestinal tract at least temporarily without any harm to the subject. Only certain strains of microorganisms have these properties. Preferably, the probiotic microorganism is selected from the group comprising *Lactobacillus* spp., *Bifidobacterium* spp., *Bacillus* spp., *Enterococcus* spp., *Escherichia* spp., *Streptococcus* spp., and *Saccharomyces* spp. Specific microorganisms include, but are not limited to *Bacillus subtilis, Bacillus cereus, Bifidobacterium bificum, Bifidobacterium breve, Bifidobacterium infantis, Bifidobacterium lactis, Bifidobacterium longum, Bifidobacterium thermophilum, Enterococcus faecium, Enterococcus faecium, Lactobacillus acidophilus, Lactobacillus bulgaricus, Lactobacillus casei, Lactobacillus lactis, Lactobacillus plantarum, Lactobacillus reuteri, Lactobacillus rhamnosus, Streptococcus faecium, Streptococcus mutans, Streptococcus thermophilus, Saccharomyces boulardii, Torulopsia, Aspergillus oryzae,* and *Streptomyces* among others, including their vegetative spores, non-vegetative spores (*Bacillus*) and synthetic derivatives. More preferred probiotic microorganisms include, but are not limited to members of three bacterial genera: *Lactobacillus, Bifidobacterium* and *Saccharomyces*. In a preferred embodiment, the probiotic microorganism is *Lactobacillus, Bifidobacterium,* and a combination thereof.

The probiotic organism can be incorporated into the composition as a culture in water or another liquid or semisolid medium in which the probiotic remains viable. In another technique, a freeze-dried powder containing the probiotic organism may be incorporated into a particulate material or liquid or semi-solid material by mixing or blending.

In a preferred embodiment, the composition comprises a probiotic organism in an amount sufficient to delivery at least 1 to 200 billion viable probiotic organisms (colony forming units; "CFUs"), preferably 1 to 100 billion, and most preferably 1 to 50 billion viable probiotic organisms. The amount of probiotic organisms delivery as describe above is may be per dosage and/or per day, where multiple dosages per day may be suitable for some applications. Two or more probiotic organisms may be used in a composition.
Enzymatic Synthesis of the Soluble α-Glucan Fiber Composition Methods are provided to enzymatically produce a soluble α-glucan fiber composition comprising α-(1,2) glycosidic linkages. More specifically, a polypeptide having α-(1,2) branching activity is used to add, in the presence of sucrose, α-(1,2) glycosidic linkages to an α-glucan substrate backbone having an effective amount of α-(1,6) glycosidic linkages.

In one embodiment, the polypeptide having α-(1,2) branching activity comprises an amino acid sequence having at least 90%, preferably at least 91, 92, 93, 94, 95, 96, 97, 98, 99 or 100% to SEQ ID NO: 6 with the proviso that the polypeptide does not comprise a second catalytic domain capable of synthesizing α-glycosidic linkages other than α-(1,2) glycosidic linkages.
Synthesis of the α-Glucan Substrate Backbone The present soluble fiber is obtained by the addition of α-(1,2) glycosidic linkages to an α-glucan substrate ("backbone") comprising an effective amount of α-(1,6) glycosidic linkages in the backbone. In one embodiment, the effective amount of α-(1,6) linkages in the α-(1,6) glucan substrate backbone is at least 50%, 60%, 70%, 80%, 90%, 95% or 98% or all α-glycosidic linkages in the molecule. A variety of enzymes may be used to produce a suitable α-glucan substrate backbone (i.e., having an effective amount of α-(1,6) glycosidic linkages suitable for the enzymatic addition of α-(1,2) branching) from sucrose and/or maltodextrin. The enzymes used to prepare the glucan backbone may include glucosyltransferases (typically from the GH70 family of glycoside hydrolases), dextrin dextranases, 4,6-α-glucosyltransferases ("Gtf-B type" from family GH70), and combinations thereof; optionally in combination with at least one α-glucosidase; preferably wherein the α-glucosidase is an dextranase, a mutanase, or a combination thereof.
Glycoside Hydrolase Family 70

Glycoside hydrolase family 70 enzymes ("GH70") are transglucosidases produced by lactic acid bacteria such as *Streptococcus, Leuconostoc, Weisella* or *Lactobacillus* genera (see Carbohydrate Active Enzymes database; "CAZy"; Cantarel et al., (2009) *Nucleic Acids Res* 37:D233-238). The recombinantly expressed glucosyltransferases preferably have an amino acid sequence identical to that found in nature (i.e., the same as the full length sequence as found in the source organism or a catalytically active truncation thereof).

The GTF enzymes are able to polymerize the D-glucosyl units of sucrose to form homooligosaccharides or homopolysaccharides. Depending upon the specificity of the GTF enzyme, linear and/or branched glucans comprising various glycosidic linkages may be formed such as α-(1,2), α-(1,3), α-(1,4) and α-(1,6). Glucosyltransferases may also transfer the D-glucosyl units onto hydroxyl acceptor groups. A non-limiting list of acceptors may include carbohydrates, alcohols, polyols or flavonoids. The structure of the resultant glucosylated product is dependent upon the enzyme specificity.

In one embodiment, the D-glucopyranosyl donor is sucrose. As such the reaction is:

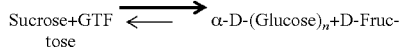

Sucrose+GTF ⇌ α-D-(Glucose)$_n$+D-Fructose

The type of glycosidic linkage predominantly formed is used to name/classify the glucosyltransferase enzyme. Examples include dextransucrases (α-(1,6) linkages; EC 2.4.1.5), mutansucrases (α-(1,3) linkages; EC 2.4.1.-), alternansucrases (alternating α(1,3)-α(1,6) backbone; EC 2.4.1.140), and reuteransucrases (mix of α-(1,4) and α-(1,6) linkages; EC 2.4.1.-).

In one embodiment, the soluble α-glucan substrate is enzymatically synthesized from sucrose (α-D-Glucopyranosyl β-D-fructofuranoside; CAS #57-50-1) obtainable from sugarcane or sugar beet. In one embodiment, the method comprises the use of at least one recombinantly produced glucosyltransferase belong to glucoside hydrolase type 70 (E.C. 2.4.1.-) capable of catalyzing the synthesis of a suitable α-glucan substrate backbone using sucrose as a substrate. In a preferred aspect, the resulting α-glucan substrate backbone is water soluble.

In one aspect, the backbone-synthesizing glucosyltransferase (GTF) is capable of forming glucans having at least 50% or more α-(1,6) glycosidic linkages with the proviso that that glucan product is not alternan (i.e., the enzyme is not an alternansucrase).

In one aspect, the glucosyltransferase comprises an amino acid sequence having at least 90%, preferably 91, 92, 93, 94, 95, 96, 97, 98, 99 or 100% identity to an amino acid sequence SEQ ID NOs: 7, 9, 10, 11, 12, 13, 14 or 16. In another aspect, the glucosyltransferase comprises an amino acid sequence having at least 90%, preferably 91, 92, 93, 94, 95, 96, 97, 98, 99 or 100% identity to an amino acid sequence selected from the group consisting of SEQ ID NOs: 7, 9, 10, 11, 12, and 13. However, it should be noted that some wild type sequences may be found in nature in a truncated form. As such, and in a further embodiment, the glucosyltransferase suitable for use may be a truncated form of the wild type sequence. In a further embodiment, the truncated glucosyltransferase comprises a sequence derived from the full length wild type amino acid sequence.
GH70 Glucosyltransferase/α-Glucanohydrolase Combinations to Produce the α-Glucan Substrate Backbone In another embodiment, a combination of a glucosyltransferase (GH70) and an α-glucanohydrolase (for example, a dextranase or mutanase) are used to produce the suitable α-glucan substrate backbone. In a preferred aspect, the glucosyltransferase and the α-glucanohydrolase are used concomitantly to produce the α-glucan substrate backbone.

The α-glucanohydrolase used to synthesize (in combination with at least one glucosyltransferase) is preferably a dextranase or mutanase; preferably and endomutanase or endodextranase. In one embodiment, the α-glucanohydrolase is a dextranase (EC 2.1.1.11), a mutanase (EC 3.1.1.59) or a combination thereof. In one embodiment, the dextranase is a food grade dextranase from *Chaetomium erraticum*. In a further embodiment, the dextranase from *Chaetomium erraticum* is DEXTRANASE® PLUS L, available from Novozymes A/S, Denmark.

In another embodiment, the α-glucanohydrolase is at least one mutanase (EC 3.1.1.59). In one embodiment, the mutanase is one obtainable from the genera *Penicillium, Paenibacillus, Hypocrea, Aspergillus,* and *Trichoderma*. In a further embodiment, the mutanase is from *Penicillium marneffei* ATCC 18224 or *Paenibacillus Humicus*. In yet a further embodiment, the mutanase comprises an amino acid having at least 90% identity, preferably at least 91, 92, 93, 94, 95, 96, 97, 98, 99 or 100% identity to an amino acid sequence selected from SEQ ID NO: 21, 23, and any combination thereof. In another embodiment, the above mutanases may be a catalytically active truncation so long as the mutanase activity is retained. In yet a further preferred embodiment, the mutanase comprises SEQ ID NO: 21, 23 or a combination thereof.

In a further embodiment, a combination of a glucosyltransferase having at least 90% identity, preferably 91, 92, 93, 94, 95, 96, 97, 98, 99 or 100% identity to SEQ ID NO: 14 or 16 is used concomitantly with a mutanase having at least 90% identity, preferably 91, 92, 93, 94, 95, 96, 97, 98, 99 or 100% identity to SEQ ID NO: 21 or 23. In a preferred embodiment, a combination of a glucosyltransferase having amino acid SEQ ID NO: 14 or 16 is used concomitantly with a mutanase having amino acid sequence SEQ ID NO: 21 or 23. In a further preferred embodiment, the a combination of a glucosyltransferase having amino acid SEQ ID NO: 16 is used concomitantly with a mutanase of SEQ ID NO: 21 to produce the desired α-glucan substrate backbone (i.e., GTF0544/MUT3264).

Production of α-Glucan Substrate Backbone from Maltodextrin

The α-glucan substrate backbone may be synthesized from a maltodextrin substrate. In one embodiment, at least one polypeptide having dextrin dextranase activity (E.C. 2.4.1.2) is used to synthesize the α-glucan substrate backbone. The maltodextrin substrate/maltooligosaccharide is obtainable from processed starch or may be obtained enzymatically from sucrose using an amylosucrase (an example is provided as SEQ ID NO: 71).

The polypeptide having dextrin dextranase activity may be used in combination with at least one α-glucanohydrolase to produce the α-glucan substrate backbone. In one embodiment, the polypeptide having dextrin dextranase activity is used concomitantly with at least one α-glucanohydrolase to produce a suitable α-glucan substrate backbone. In a preferred embodiment, the α-glucanohydrolase is a dextranase, preferably an endodextranase. The enzymes used preferably have an amino acid sequence identical to that found in nature (i.e., the same as the full length sequence as found in the source organism or a catalytically active truncation thereof).

In one aspect, the polypeptide having dextrin dextranase activity comprises an amino acid sequence having at least 90%, preferably 91, 92, 93, 94, 95, 96, 97, 98, 99 or 100% identity to SEQ ID NO: 26. However, it should be noted that some wild type sequences may be found in nature in a truncated form. As such, and in a further embodiment, the dextrin dextranase suitable for use may be a truncated form of the wild type sequence. In a further embodiment, the truncated glucosyltransferase comprises a sequence derived from SEQ ID NO: 26.

In one aspect, the endodextranase is obtained from *Chaetomium*, preferably *Chaetomium erraticum*. In a further preferred aspect, the endodextranase is Dextranase L from *Chaetomium erraticum*. In a preferred embodiment, the endodextranase does not have significant maltose hydrolyzing activity, preferably no maltose hydrolyzing activity.

The ratio of dextrin dextranase activity to α-glucanohydrolase (i.e., endodextranase) activity may vary depending upon the selected enzymes. In one embodiment, the ratio of dextrin dextranase activity to α-glucanohydrolase activity ranges from 1:0.01 to 0.01:1.0.

In one embodiment, at least one polypeptide having 4,6-α-glucosyltransferase activity ("Gtf-B type" GH70) is used to synthesize the α-glucan substrate backbone. The maltodextrin substrate/maltooligosaccharide is obtainable from processed starch or may be obtained enzymatically from sucrose using an amylosucrase (an example is provided as SEQ ID NO: 71).

The polypeptide having 4,6-α-glucosyltransferase activity may be used in combination with at least one α-glucanohydrolase to produce the α-glucan substrate backbone. In one embodiment, the polypeptide having 4,6-α-glucosyltransferase activity is used concomitantly with at least one α-glucanohydrolase to produce a suitable α-glucan substrate backbone. In a preferred embodiment, the α-glucanohydrolase is a dextranase, preferably an endodextranase. The enzymes used preferably have an amino acid sequence identical to that found in nature (i.e., the same as the full length sequence as found in the source organism or a catalytically active truncation thereof).

In one aspect, the polypeptide having 4,6-α-glucosyltransferase activity comprises an amino acid sequence having at least 90%, preferably 91, 92, 93, 94, 95, 96, 97, 98, 99 or 100% identity to SEQ ID NO: 68, 69, or 70. However, it should be noted that some wild type sequences may be found in nature in a truncated form. As such, and in a further embodiment, the 4,6-α-glucosyltransferase may be a truncated form of the wild type sequence. In a further embodiment, the truncated 4,6-α-glucosyltransferase comprises a sequence derived from SEQ ID NO: 68, 69 or 70.

In one aspect, the endodextranase is obtained from *Chaetomium*, preferably *Chaetomium erraticum*. In a further preferred aspect, the endodextranase is Dextranase L from *Chaetomium erraticum*.

The ratio of 4,6-α-glucosyltransferase activity to α-glucanohydrolase (i.e., endodextranase) activity may vary depending upon the selected enzymes. In one embodiment, the ratio of 4,6-α-glucosyltransferase activity to α-glucanohydrolase activity ranges from 1:0.01 to 0.01:1.0.

The maltodextrin substrate concentration (when synthesizing the α-glucan substrate backbone) initially present when the reaction components are combined is at least 10 g/L, preferably 50 g/L to 500 g/L, more preferably 100 g/L to 500 g/L, more preferably 150 g/L to 450 g/L, and most preferably 250 g/L to 450 g/L. The maltodextrin substrate will typically have a DE ranging from 3 to 40, preferably 3 to 20; corresponding to a DP range of 3 to about 40, preferably 6 to 40, and most preferably 6 to 25).

When present in the α-glucan substrate backbone synthesis reaction, the substrate for the α-glucanohydrolase will be the members of the glucose oligomer population formed by the backbone synthesis enzymes (glucosyltransferases, dextrin dextranases, 4,6-α-glucosyltransferase, etc.). The exact concentration of each species present in the reaction system will vary.

Enzymatic Synthesis of α-(1, 2) Branched Soluble Glucan Fiber Compositions

A method is provided to synthesize the present soluble α-glucan fiber compositions by enzymatically adding α-(1, 2) branching to an α-glucan substrate backbone having at least 50% α-(1,6) glycosidic linkages. Methods to produce an α-glucan substrate backbone are described above.

In one aspect, the suitable reaction components comprises at least one polypeptide having α-(1,2) branching activity, sucrose, and at least one α-glucan substrate having an effective amount of α-(1,6) glycosidic linkages. The α-glucan substrate having an effective amount of α-(1,6) glycosidic linkages in the "backbone" may be synthesized from (1) sucrose using at least one glucansucrase enzyme, (2) maltodextrins obtainable from processed starch or sucrose that have been contacted with at least one dextrin dextranase, at least one "Gtf-B type" 4,6-α-glucosyltransferase, and combinations thereof or (3) any combination thereof. The α-glucan substrate "backbone" having an effective amount of α-(1,6) glycosidic linkages may be synthesized prior to enzymatically adding the α-(1,2) branching or may be synthesized concomitantly in the same reaction mixture comprising at least one polypeptide having α-(1,2) branching activity with the proviso that the polypeptide having α-(1,2) branching activity is not the same as the enzyme(s) used to synthesize the α-glucan substrate "backbone" having an effective amount of α-(1,6) glycosidic linkages. In a further aspect, the α-glucan substrate "backbone" to which α-(1,2) branching is added is produced using a single glucansucrase, a combination of glucansucrases, a combination of at least glucansucrase and at least one α-glucanohydrolase, a dextran dextrinase, a "GtfB type" glucosyltransferase (i.e., a 4,6-α-glucosyltransferase; Kralj et al., Appl. Env. Microbiol. (2011) 77(22): 8154-8163), a combination of a dextrin dextranase and at least one α-glucanohydrolase, a combination of a "GtfB-type" glucosyltransferase and at least one α-glucanohydrolase, and any combination thereof.

In one embodiment, the polypeptide having α-(1,2) branching activity is a truncated glucosyltransferase comprising a catalytic domain capable of adding α-(1,2) branching to an α-glucan substrate backbone. In one embodiment, the catalytic domain capable of adding α-(1,2) branching further comprises at least one glucan binding domain. Preferably, the polypeptide having α-(1,2) branching activity is a truncated glucosyltransferase wherein the domain capable of synthesizing linkages other than α-(1,2) glycosidic linkage is not present (i.e., the backbone synthesizing domain or "CD1" domain found in enzymes such as the GtfJ18 glucosyltransferase from *Leuconostoc mesenteroides* subsp. *mesenteroides* J18, see GENBANK® gi:356644413 (SEQ ID NO: 1) and the DsrE glucosyltransferase from *Leuconostoc mesenteroides* NRRL B-1299 as reported in GENBANK® gi:23320943; SEQ ID NO: 2). In a preferred embodiment, the polypeptide having α-(1,2) branching activity comprises an amino acid sequence having at least 80%, 85%, 90%, 91%, 92%, 93%, 94%, 95%, 96%, 97%, 98%, 99% or 100% amino acid identity to SEQ ID NO: 6. In a further preferred aspect, the polypeptide having α-(1,2) branching activity consists essentially of an amino acid sequence having at least 80%, 85%, 90%, 91%, 92%, 93%, 94%, 95%, 96%, 97%, 98%, 99% or 100% amino acid identity to SEQ ID NO: 6.The concentration of the catalysts in the aqueous reaction formulation depends on the specific catalytic activity of each catalyst, and are chosen to obtain the desired overall rate of reaction. The weight of each catalyst typically ranges from 0.0001 mg to 20 mg per mL of total reaction volume, preferably from 0.001 mg to 10 mg per mL. The catalyst(s) may also be immobilized on a soluble or insoluble support using methods well-known to those skilled in the art; see for example, *Immobilization of Enzymes and Cells;* Gordon F. Bickerstaff, Editor; Humana Press, Totowa, N.J., USA; 1997. The use of immobilized catalysts permits the recovery and reuse of the catalyst in subsequent reactions. The enzyme catalyst(s) may be in the form of whole microbial cells, permeabilized microbial cells, microbial cell extracts, partially-purified or purified enzymes, and mixtures thereof.

The pH of the final reaction formulation is from about 3 to about 8, preferably from about 4 to about 8, more preferably from about 5 to about 8, even more preferably about 5.5 to about 7.5, and yet even more preferably about 5.5 to about 6.5. The pH of the reaction may optionally be controlled by the addition of a suitable buffer including, but not limited to, phosphate, pyrophosphate, bicarbonate, acetate, or citrate. The concentration of buffer, when employed, is typically from 0.1 mM to 1.0 M, preferably from 1 mM to 300 mM, most preferably from 10 mM to 100 mM.

The α-glucan substrate backbone concentration may range depending if the backbone is synthesized prior to enzymatic α-(1,2) branching or if the backbone is synthesize concomitantly with the enzymatic α-(1,2) branching. In one embodiment, the α-glucan substrate backbone concentration at the initiation of α-(1,2) branching is least 10 g/L, preferably 50 g/L to 500 g/L, more preferably 100 g/L to 500 g/L, more preferably 150 g/L to 450 g/L, and most preferably 250 g/L to 450 g/L.

The sucrose substrate concentration used during the α-(1,2) branching reaction may vary. In one embodiment, the sucrose concentration initially present when the reaction components are combined is at least 50 g/L, preferably 50 g/L to 600 g/L, more preferably 100 g/L to 500 g/L, more preferably 150 g/L to 450 g/L, and most preferably 250 g/L to 450 g/L. Higher concentrations of sucrose may be necessary if the α-(1,2) branching reaction occurs concomitantly with α-glucan backbone synthesis reaction.

The weight ratio of sucrose to α-glucan substrate backbone during the branching reaction may vary. In one embodiment, the weight ration of sucrose to α-glucan substrate backbone may range from 0.01:1.0 to 1.0:0.01.

The length of the reaction may vary and may often be determined by the amount of time it takes to use all of the available sucrose substrate. In one embodiment, the reaction is conducted until at least 90%, preferably at least 95% and most preferably at least 99% of the sucrose initially present in the reaction mixture is consumed. In another embodiment, the reaction time is 1 hour to 168 hours, preferably 1 hour to 72 hours, and most preferably 1 hour to 24 hours.

The maltodextrin substrate concentration initially present (when synthesizing the α-glucan substrate backbone from maltodextrin concomitantly with the enzymatic addition of α-(1,2) branching using sucrose) when the reaction components are combined is at least 10 g/L, preferably 50 g/L to 500 g/L, more preferably 100 g/L to 500 g/L, more preferably 150 g/L to 450 g/L, and most preferably 250 g/L to 450 g/L. The maltodextrin substrate will typically have a DE ranging from 3 to 40, preferably 3 to 20; corresponding to a DP range of 3 to about 40, preferably 6 to 40, and most preferably 6 to 25).

The length of the reaction may vary and may often be determined by the amount of time it takes to use all of the available sucrose substrate. In one embodiment, the reaction is conducted until at least 90%, preferably at least 95% and most preferably at least 99% of the maltodextrin substrate initially present in the reaction mixture is consumed. In another embodiment, the reaction time is 1 hour to 168 hours, preferably 1 hour to 120 hours, and most preferably 1 hour to 72 hours.

The temperature of the enzymatic reaction system may be chosen to control both the reaction rate and the stability of the enzyme catalyst(s) used. The temperature of the reaction may range from just above the freezing point of the reaction formulation (approximately 0° C.) to about 60° C., with a preferred range of 5° C. to about 55° C., and a more preferred range of reaction temperature of from about 20° C. to about 47° C.

In a "first" embodiment, a method is provided to produce a soluble α-glucan fiber composition comprising:
a. providing a set of reaction components comprising:
i. sucrose;
ii. an α-glucan substrate backbone having a weight average molecular weight of at least 0.5 kDa, said α-glucan substrate backbone comprising at least 50% α-(1,6) glycosidic linkages;
iii. a polypeptide having α-(1,2) branching activity, said polypeptide comprising an amino acid sequence having at least 90% identity to SEQ ID NO: 6; said polypeptide capable of catalyzing the synthesis of α-(1,2) glycosidic linkages on the α-glucan substrate backbone; and
iv. optionally one or more acceptors;
b. combining the set of reaction component under suitable aqueous reaction conditions whereby the polypeptide catalyzing the synthesis of an α-glucan fiber composition comprising 1 to 50% of a combination of α-(1,2) and α-(1,2,6) glycosidic linkages; and
c. optionally isolating the α-glucan fiber composition.

In a further embodiment to the above, the method further comprises a step of: (d) concentrating the α-glucan fiber composition.

In a further embodiment to any of the above embodiments, the α-glucan substrate comprises 1% to 50% of α-(1,3) glycosidic linkages.

In a further embodiment to any of the above embodiments, the α-glucan substrate backbone comprises more than 10% but less than 40% α-(1,4) glycosidic linkages.

In a further embodiment to any of the above embodiments, the α-glucan fiber composition comprises
a. a viscosity of less than 10 cps at 12 wt % in water;
b. a digestibility of less than 20% as measured by the Association of Analytical Communities (AOAC) method 2009.01;
c. a solubility of at least 20% (w/w) in water at 25° C.; and
d. a polydispersity index of less than 5.

In another embodiment, a method is provided to produce an α-glucan fiber composition comprising:
a. contacting sucrose with at least one glucosyltransferase or a combination of at least one glucosyltransferase and at least one α-glucanohydrolase under suitable reaction conditions whereby an α-glucan substrate backbone is produced having a weight average molecular weight of at least 0.5 kDa, said α-glucan substrate backbone comprising at least 50% α-(1,6) glycosidic linkages; wherein said α-glucan substrate comprises less than 1% α-(1,2) glycosidic linkages;
b. contacting the α-glucan substrate backbone produced in (a) with a set of reaction components comprising
i. a polypeptide having α-(1,2) branching activity comprising an amino acid sequence having at least 90% identity to SEQ ID NO: 6; said polypeptide capable of catalyzing the synthesis of α-(1,2) glycosidic linkages on the α-glucan substrate;
ii. sucrose; and
iii. optionally one or more acceptors;
c. combining the set of reaction components of (b) under suitable aqueous reaction conditions whereby the polypeptide catalyzing the synthesis of an α-glucan fiber composition comprises 1 to 50% α-(1,2) glycosidic linkages; and
d. optionally isolating the α-glucan fiber composition of step (c).

In a further embodiment, the at least one glucosyltransferase of step (a) comprises an amino acid sequence having at least 90% identity to an amino acid sequence selected from the group consisting of SEQ ID NOs: 7, 9, 10, 11, 12, 13, 14 and 16.

In a further embodiment, wherein the combination of at least one glucosyltransferase and at least one α-glucanohydrolase of step (a) is:
a. the at least one glucosyltransferase comprises an amino acid sequence SEQ ID NO: 14, 16 or a combination thereof; and
b. The at least one α-glucanohydrolase comprises an amino acid sequence selected from the group consisting of SEQ ID NOs: 21, 23 or a combination thereof.

In another embodiment, a method to produce an α-glucan fiber composition comprising:
a. contacting a maltodextrin substrate with
i. a dextrin dextranase or
ii. a combination of a dextrin dextranase and at least one α-glucanohydrolase under suitable aqueous reaction conditions; whereby an α-glucan substrate backbone is produced having a weight average molecular weight of at least 0.5 kDa, said α-glucan substrate backbone comprising at least 50% α-(1,6) glycosidic linkages; wherein said α-glucan substrate comprises less than 1% α-(1,2) glycosidic linkages;
b. contacting the α-glucan substrate backbone produced in (a) with a set of reaction components comprising
i. a polypeptide comprising an amino acid sequence having at least 90% identity to SEQ ID NO: 6; said polypeptide capable of catalyzing the synthesis of α-(1,2) glycosidic linkages on the α-glucan substrate backbone;
ii. sucrose; and
iii. optionally one or more acceptors;
c. combining the set of reaction components of (b) under suitable aqueous reaction conditions whereby the polypeptide catalyzing the synthesis of an α-glucan fiber composition comprising 1 to 50% of a combination of α-(1,2) and α-(1,2,6) glycosidic linkages; and
d. optionally isolating the α-glucan fiber composition of step (c).

In another embodiment, a method is provided to produce an α-glucan fiber composition comprising:
a. providing a set of reaction components comprising
i. a maltodextrin substrate;
ii. a 4,6-α-glucosyltransferase or a combination of a 4,6-α-glucosyltransferase and at least one α-glucanohydrolase under suitable aqueous reaction conditions;
iii. a polypeptide comprising an amino acid sequence having at least 90% identity to SEQ ID NO: 6; said polypeptide capable of catalyzing the synthesis of α-(1,2) glycosidic linkages on an α-glucan substrate;
iv. sucrose; and
v. optionally one or more acceptors;
b. combining the set of reaction components of (a) under suitable aqueous reaction conditions whereby an α-glucan fiber composition comprising 1 to 50% of a combination of α-(1,2) and α-(1,2,6) glycosidic linkages is produced; and
c. optionally isolating the α-glucan fiber composition of step (b).

In a further embodiment to any of the above methods, the soluble α-glucan fiber composition is isolated comprising at least one of centrifugation, filtration, fractionation, chromatographic separation, dialysis, evaporation, dilution or any combination thereof.

Methods to Identify Substantially Similar Enzymes Having the Desired Activity

The skilled artisan recognizes that substantially similar enzyme sequences may also be used in the present compositions and methods so long as the desired activity is retained (i.e., glucosyltransferase activity capable of forming glucans having the desired glycosidic linkages or α-glucanohydrolases having endohydrolytic activity towards the target glycosidic linkage(s)). For example, it has been demonstrated that catalytically activity truncations may be prepared and used so long as the desired activity is retained (or even improved in terms of specific activity). In one embodiment, substantially similar sequences are defined by their ability to hybridize, under highly stringent conditions with the nucleic acid molecules associated with sequences exemplified herein. In another embodiment, sequence alignment algorithms may be used to define substantially similar enzymes based on the percent identity to the DNA or amino acid sequences provided herein.

As used herein, a nucleic acid molecule is "hybridizable" to another nucleic acid molecule, such as a cDNA, genomic DNA, or RNA, when a single strand of the first molecule can anneal to the other molecule under appropriate conditions of temperature and solution ionic strength. Hybridization and washing conditions are well known and exemplified in Sambrook, J. and Russell, D., T. *Molecular Cloning: A Laboratory Manual*, Third Edition, Cold Spring Harbor Laboratory Press, Cold Spring Harbor (2001). The conditions of temperature and ionic strength determine the "stringency" of the hybridization. Stringency conditions can be adjusted to screen for moderately similar molecules, such as homologous sequences from distantly related organisms, to highly similar molecules, such as genes that duplicate functional enzymes from closely related organisms. Post-hybridization washes typically determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of conditions uses higher temperatures in which the washes are identical to those above except for the temperature of the final two 30 min washes in 0.2×SSC, 0.5% SDS was increased to 60° C. Another preferred set of highly stringent hybridization conditions is 0.1×SSC, 0.1% SDS, 65° C. and washed with 2×SSC, 0.1° A SDS followed by a final wash of 0.1×SSC, 0.1% SDS, 65° C.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (Sambrook, J. and Russell, D., T., supra). For hybridizations with shorter nucleic acids, i.e., oligonucleotides, the position of mismatches becomes more important, and the length of the oligonucleotide determines its specificity. In one aspect, the length for a hybridizable nucleic acid is at least about 10 nucleotides. Preferably, a minimum length for a hybridizable nucleic acid is at least about 15 nucleotides in length, more preferably at least about 20 nucleotides in length, even more preferably at least 30 nucleotides in length, even more preferably at least 300 nucleotides in length, and most preferably at least 800 nucleotides in length. Furthermore, the skilled artisan will recognize that the temperature and wash solution salt concentration may be adjusted as necessary according to factors such as length of the probe.

As used herein, the term "percent identity" is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the number of matching nucleotides or amino acids between strings of such sequences. "Identity" and "similarity" can be readily calculated by known methods, including but not limited to those described in: *Computational Molecular Biology* (Lesk, A. M., ed.) Oxford University Press, NY (1988); *Biocomputing: Informatics and Genome Projects* (Smith, D. W., ed.) Academic Press, NY (1993); *Computer Analysis of Sequence Data, Part I* (Griffin, A. M., and Griffin, H. G., eds.) Humana Press, NJ (1994); *Sequence Analysis in Molecular Biology* (von Heinje, G., ed.) Academic Press (1987); and *Sequence Analysis Primer* (Gribskov, M. and Devereux, J., eds.) Stockton Press, NY (1991). Methods to determine identity and similarity are codified in publicly available computer programs. Sequence alignments and percent identity calculations may be performed using the Megalign program of the LASERGENE bioinformatics computing suite (DNASTAR Inc., Madison, Wis.), the AlignX program of Vector NTI v. 7.0 (Informax, Inc., Bethesda, Md.), or the EMBOSS Open Software Suite (EMBL-EBI; Rice et al., *Trends in Genetics* 16, (6):276-277 (2000)). Multiple alignment of the sequences can be performed using the CLUSTAL method (such as CLUSTALW; for example version 1.83) of alignment (Higgins and Sharp, *CABIOS*, 5:151-153 (1989); Higgins et al., *Nucleic Acids Res.* 22:4673-4680 (1994); and Chenna et al., *Nucleic Acids Res* 31 (13):3497-500 (2003)), available from the European Molecular Biology Laboratory via the European Bioinformatics Institute) with the default parameters. Suitable parameters for CLUSTALW protein alignments include GAP Existence penalty=15, GAP extension =0.2, matrix=Gonnet (e.g., Gonnet250), protein ENDGAP=-1, protein GAPDIST=4, and KTUPLE=1. In one embodiment, a fast or slow alignment is used with the default settings where a slow alignment is preferred. Alternatively, the parameters using the CLUSTALW method (e.g., version 1.83) may be modified to also use KTUPLE=1, GAP PENALTY=10, GAP extension=1, matrix=BLOSUM (e.g., BLOSUM64), WINDOW=5, and TOP DIAGONALS SAVED=5.

In one aspect, suitable isolated nucleic acid molecules encode a polypeptide having an amino acid sequence that is at least about 20%, preferably at least 30%, 40%, 50%, 60%, 70%, 80%, 85%, 90%, 91%, 92%, 93%, 94%, 95%, 96%, 97%, 98%, or 99% identical to the amino acid sequences reported herein. In another aspect, suitable isolated nucleic acid molecules encode a polypeptide having an amino acid sequence that is at least about 20%, preferably at least 30%, 40%, 50%, 60%, 70%, 80%, 85%, 90%, 91%, 92%, 93%, 94%, 95%, 96%, 97%, 98%, or 99% identical to the amino acid sequences reported herein; with the proviso that the polypeptide retains the respective activity (i.e., glucosyltransferase or α-glucanohydrolase activity).

Methods to Obtain the Enzymatically-Produced Soluble α-Glucan Fiber Composition

Any number of common purification techniques may be used to obtain the present soluble α-glucan fiber composition from the reaction system including, but not limited to centrifugation, filtration, fractionation, chromatographic separation, dialysis, evaporation, precipitation, dilution or any combination thereof, preferably by dialysis or chromatographic separation, most preferably by dialysis (ultrafiltration).

Recombinant Microbial Expression

The genes and gene products of the instant sequences may be produced in heterologous host cells, particularly in the cells of microbial hosts. Preferred heterologous host cells for expression of the instant genes and nucleic acid molecules are microbial hosts that can be found within the fungal or bacterial families and which grow over a wide range of temperature, pH values, and solvent tolerances. For example, it is contemplated that any of bacteria, yeast, and filamentous fungi may suitably host the expression of the present nucleic acid molecules. The enzyme(s) may be expressed intracellularly, extracellularly, or a combination of both intracellularly and extracellularly, where extracellular expression renders recovery of the desired protein from a fermentation product more facile than methods for recovery of protein produced by intracellular expression. Transcription, translation and the protein biosynthetic apparatus remain invariant relative to the cellular feedstock used to generate cellular biomass; functional genes will be expressed regardless. Examples of host strains include, but are not limited to, bacterial, fungal or yeast species such as *Aspergillus, Trichoderma, Saccharomyces, Pichia, Phaffia, Kluyveromyces, Candida, Hansenula, Yarrowia, Salmonella, Bacillus, Acinetobacter, Zymomonas, Agrobacterium, Erythrobacter, Chlorobium, Chromatium, Flavobacterium, Cytophaga, Rhodobacter, Rhodococcus, Streptomyces, Brevibacterium, Corynebacteria, Mycobacterium, Deinococcus, Escherichia, Erwinia, Pantoea, Pseudomonas, Sphingomonas, Methylomonas, Methylobacter, Methylococcus, Methylosinus, Methylomicrobium, Methylocystis, Alcaligenes, Synechocystis, Synechococcus, Anabaena, Thiobacillus, Methanobacterium, Klebsiella*, and *Myxococcus*. In one embodiment, the fungal host cell is *Trichoderma*, preferably a strain of *Trichoderma reesei*. In one embodiment, bacterial host strains include *Escherichia, Bacillus, Kluyveromyces*, and *Pseudomonas*. In a preferred embodiment, the bacterial host cell is *Bacillus subtilis* or *Escherichia coli*.

Large-scale microbial growth and functional gene expression may use a wide range of simple or complex carbohydrates, organic acids and alcohols or saturated hydrocarbons, such as methane or carbon dioxide in the case of photosynthetic or chemoautotrophic hosts, the form and amount of nitrogen, phosphorous, sulfur, oxygen, carbon or any trace micronutrient including small inorganic ions. The regulation of growth rate may be affected by the addition, or not, of specific regulatory molecules to the culture and which are not typically considered nutrient or energy sources.

Vectors or cassettes useful for the transformation of suitable host cells are well known in the art. Typically the vector or cassette contains sequences directing transcription and translation of the relevant gene, a selectable marker, and sequences allowing autonomous replication or chromosomal integration. Suitable vectors comprise a region 5' of the gene which harbors transcriptional initiation controls and a region 3' of the DNA fragment which controls transcriptional termination. It is most preferred when both control regions are derived from genes homologous to the transformed host cell and/or native to the production host, although such control regions need not be so derived.

Initiation control regions or promoters which are useful to drive expression of the present cephalosporin C deacetylase coding region in the desired host cell are numerous and familiar to those skilled in the art. Virtually any promoter capable of driving these genes is suitable for the present invention including but not limited to, CYC1, HIS3, GAL1, GAL10, ADH1, PGK, PHO5, GAPDH, ADC1, TRP1, URA3, LEU2, ENO, TPI (useful for expression in *Saccharomyces*); AOX1 (useful for expression in *Pichia*); and lac, araB, tet, trp, $IP_L$, $IP_R$, T7, tac, and trc (useful for expression in *Escherichia coli*) as well as the amy, apr, npr promoters and various phage promoters useful for expression in *Bacillus*.

Termination control regions may also be derived from various genes native to the preferred host cell. In one embodiment, the inclusion of a termination control region is optional. In another embodiment, the chimeric gene includes a termination control region derived from the preferred host cell.

Industrial Production

A variety of culture methodologies may be applied to produce the enzyme(s). For example, large-scale production of a specific gene product over-expressed from a recombinant microbial host may be produced by batch, fed-batch, and continuous culture methodologies. Batch and fed-batch culturing methods are common and well known in the art and examples may be found in *Biotechnology: A Textbook of Industrial Microbiology* by Wulf Crueger and Anneliese Crueger (authors), Second Edition, (Sinauer Associates, Inc., Sunderland, Mass. (1990) and *Manual of Industrial Microbiology and Biotechnology*, Third Edition, Richard H. Baltz, Arnold L. Demain, and Julian E. Davis (Editors), (ASM Press, Washington, D.C. (2010).

Commercial production of the desired enzyme(s) may also be accomplished with a continuous culture. Continuous cultures are an open system where a defined culture media is added continuously to a bioreactor and an equal amount of conditioned media is removed simultaneously for processing. Continuous cultures generally maintain the cells at a constant high liquid phase density where cells are primarily in log phase growth. Alternatively, continuous culture may be practiced with immobilized cells where carbon and nutrients are continuously added and valuable products, by-products or waste products are continuously removed from the cell mass. Cell immobilization may be performed using a wide range of solid supports composed of natural and/or synthetic materials.

Recovery of the desired enzyme(s) from a batch fermentation, fed-batch fermentation, or continuous culture, may be accomplished by any of the methods that are known to those skilled in the art. For example, when the enzyme catalyst is produced intracellularly, the cell paste is separated from the culture medium by centrifugation or membrane filtration, optionally washed with water or an aqueous buffer at a desired pH, then a suspension of the cell paste in an aqueous buffer at a desired pH is homogenized to produce a cell extract containing the desired enzyme catalyst. The cell extract may optionally be filtered through an appropriate filter aid such as celite or silica to remove cell debris prior to a heat-treatment step to precipitate undesired protein from the enzyme catalyst solution. The solution containing the desired enzyme catalyst may then be separated from the precipitated cell debris and protein by membrane filtration or centrifugation, and the resulting partially-purified enzyme catalyst solution concentrated by additional membrane filtration, then optionally mixed with an appropriate carrier (for example, maltodextrin, phosphate buffer, citrate buffer, or mixtures thereof) and spray-dried to produce a solid powder comprising the desired enzyme catalyst. Alternatively, the resulting partially-purified enzyme catalyst solution can be stabilized as a liquid formulation by the addition of polyols such as maltodextrin, sorbitol, or propylene glycol, to which is optionally added a preservative such as sorbic acid, sodium sorbate or sodium benzoate.

The production of the soluble α-glucan fiber can be carried out by combining the obtained enzyme(s) under any suitable aqueos reaction conditions which result in the production of the soluble α-glucan fiber such as the conditions disclosed herein. The reaction may be carried out in water solution, or, in certain embodiments, the reaction can be carried out in situ within a food product. Methods for producing a fiber using an enzyme catalyst in situ in a food product are known in the art. In certain embodiments, the enzyme catalyst is added to a sucrose-containing liquid food product. The enzyme catalyst can reduce the amount of sucrose in the liquid food product while increasing the amount of soluble α-glucan fiber and fructose. A suitable method for in situ production of fiber using a polypeptide material (i.e., an enzyme catalyst) within a food product can be found in WO2013/182686, the contents of which are herein incorporated by reference for the disclosure of a method for in situ production of fiber in a food product using an enzyme catalyst.

When an amount, concentration, or other value or parameter is given either as a range, preferred range, or a list of upper preferable values and lower preferable values, this is to be understood as specifically disclosing all ranges formed from any pair of any upper range limit or preferred value and any lower range limit or preferred value, regardless of whether ranges are separately disclosed. Where a range of numerical values is recited herein, unless otherwise stated, the range is intended to include the endpoints thereof, and all integers and fractions within the range. It is not intended that the scope be limited to the specific values recited when defining a range.

Description of Certain Embodiments

In a first embodiment (the "first embodiment"), a soluble α-glucan fiber composition is provided, said soluble α-glucan fiber composition comprising:
  a. a range of
    i. 0% to 50%, α-(1,3) glycosidic linkages, preferably 3% to 50% or
    ii. 0% to less than 40% α-(1,4) glycosidic linkages; preferably 15% to 35% α-(1,4) glycosidic linkages; or
    iii. any combination of (i) and (ii);
  b. 1 to 50% of a combination of α-(1,2) and α-(1,2,6) glycosidic linkages, preferably 1 to 40%, more preferably 2 to 30%;
  c. 0-25% α-(1,3,6) glycosidic linkages; preferably wherein the combination of α-(1,3) glycosidic linkages and α-(1,3,6) glycosidic linkages is 3% to 50%;
  d. less than 99% α-(1,6) glycosidic linkages;
  e. a weight average molecular weight of less than 300000 Daltons, preferably in the range of 1500 to 300000 Da, more preferably 1500 to 150000 Da, more preferably 1500 to 40000 Da, and even more preferably 1500 to 20000 Da;
  f. a viscosity of less than 0.25 Pascal second (Pa·s); preferably 0.01 Pascal second (Pa·s); preferably less than 0.007 Pascal second (Pa·s) at 12 wt % in water;
  g. a digestibility of less than 20%, preferably less than 15, 10, 9, 8, 7, 6, 5, 4, 3, 2, or 1%, as measured by the Association of Analytical Communities (AOAC) method 2009.01;
  h. a solubility of at least 20% (w/w), preferably at least 30%, 40%, 50%, 60%, or 70% in pH 7 water at 25° C.; and
  i. a polydispersity index of less than 26; preferably less than 5.

In second embodiment, a carbohydrate composition is provided comprising 0.01 to 99 wt % (dry solids basis), preferably 10 to 90% wt %, of the soluble α-glucan fiber composition described above in the first embodiment.

In a third embodiment, a food product, personal care product or pharmaceutical product is provided comprising the soluble α-glucan fiber composition of the first embodiment or a carbohydrate composition comprising the soluble α-glucan fiber composition of the second embodiment.

In a fourth embodiment, a low cariogenicity composition is provided comprising the soluble α-glucan fiber composition of the first embodiment and at least one polyol.

In a fifth embodiment, a method is provided to produce a soluble α-glucan fiber composition comprising:
  a. providing a set of reaction components comprising:
    i. sucrose;
    ii. an α-glucan substrate backbone having a weight average molecular weight of at least 0.5 kDa, said α-glucan substrate comprising at least 50% α-(1,6) glycosidic linkages; preferably wherein the α-glucan substrate backbone further comprises 1 to 50% α-(1,3) glycosidic linkages;
    iii. a polypeptide comprising an amino acid sequence having at least 90% identity to SEQ ID NO: 6; said polypeptide capable of catalyzing the synthesis of α-(1,2) glycosidic linkages on the α-glucan substrate backbone; and
    iv. optionally one or more acceptors;
  b. combining the set of reaction components under suitable aqueous reaction conditions whereby the polypeptide catalyzes the synthesis of an α-glucan fiber composition comprising 1 to 50% α-(1,2) glycosidic linkages; preferably 1 to 40%, and most preferably 2 to 30% of a combination of α-(1,2) and α-(1,2,6) glycosidic linkages; and
  c. optionally isolating the α-glucan fiber composition.

In a further embodiment to the above, the α-glucan substrate backbone comprises more than 10% but less than 40% α-(1,4) glycosidic linkages.

In a further embodiment to any of the above embodiments, the α-glucan fiber composition formed by the above method comprises
  a. a viscosity of less than 0.01 10 cps Pascal second (Pa·s) at 12 wt % in water at 20° C.;
  b. a digestibility of less than 20% as measured by the Association of Analytical Communities (AOAC) method 2009.01;
  c. a solubility of at least 20% (w/w) in pH 7 water at 25° C.; and
  d. a polydispersity index of less than 5.

In a sixth embodiment, a method to produce an α-glucan fiber composition is provided comprising:
  a. contacting sucrose with at least one glucosyltransferase or a combination of at least one glucosyltransferase and at least one α-glucanohydrolase under suitable reaction conditions whereby an α-glucan substrate is produced having a weight average molecular weight of at least 0.5 kDa, said α-glucan substrate comprising at least 50% α-(1,6) glycosidic linkages; wherein said α-glucan substrate comprises less than 1% α-(1,2) glycosidic linkages;
b. contacting the α-glucan substrate produced in (a) with a set of reaction components comprising
   i. a polypeptide comprising an amino acid sequence having at least 90% identity to SEQ ID NO: 6; said polypeptide capable of catalyzing the synthesis of α-(1,2) glycosidic linkages on the α-glucan substrate;
   ii. sucrose; and
   iii. optionally one or more acceptors;
c. combining the set of reaction components under suitable aqueous reaction conditions whereby the polypeptide catalyzes the synthesis of an α-glucan fiber composition comprising 1 to 50% of a combination of α-(1,2) and α-(1,2,6) glycosidic linkages; and
d. optionally isolating the α-glucan fiber composition of step (c).

In a seventh embodiment, a method to produce an α-glucan fiber composition is provided comprising:
a. contacting a maltodextrin substrate with
   i. a dextrin dextranase or
   ii. a combination of a dextrin dextranase and at least one
α-glucanohydrolase under suitable aqueous reaction conditions; whereby an α-glucan substrate backbone is produced having a weight average molecular weight of at least 0.5 kDa, said α-glucan substrate comprising at least 50% α-(1,6) glycosidic linkages; wherein said α-glucan substrate comprises less than 1% α-(1,2) glycosidic linkages;
b. contacting the α-glucan substrate backbone produced in (a) with a set of reaction components comprising
   i. a polypeptide comprising an amino acid sequence having at least 90% identity to SEQ ID NO: 6; said polypeptide capable of catalyzing the synthesis of α-(1,2) glycosidic linkages on the α-glucan substrate;
   ii. sucrose; and
   iii. optionally one or more acceptors;
c. combining the set of reaction components under suitable aqueous reaction conditions whereby the polypeptide catalyzes the synthesis of an α-glucan fiber composition comprising 1 to 50% of a combination of α-(1,2) and α-(1,2,6) glycosidic linkages; and
d. optionally isolating the α-glucan fiber composition of step (c).

In another embodiment, a method to produce an α-glucan fiber composition is provided comprising:
a. providing a set of reaction components comprising
   i. a maltodextrin substrate;
   ii. a dextrin dextrinase;
   iii. a polypeptide comprising an amino acid sequence having at least 90% identity to SEQ ID NO: 6; said polypeptide capable of catalyzing the synthesis of α-(1,2) glycosidic linkages on an α-glucan substrate;
   iv. sucrose; and
   v. optionally one or more acceptors;
b. combining the set of reaction components under suitable aqueous reaction conditions whereby an α-glucan fiber composition comprising 1 to 50% α-(1,2) glycosidic linkages is formed; and
c. optionally isolating the α-glucan fiber composition of step (b).

In some embodiments of any of the methods, the step of combining the set of reaction components under suitable aqueous reaction conditions comprises combining the set of reaction components within a food product.

In addition to any of the above method embodiments, the method to produce an α-glucan fiber composition further comprises step (d) concentrating the α-glucan fiber composition.

In addition to any of the above embodiments, the sucrose concentration is initially at least 50 g/L; preferably at least 200 g/L when the set of reaction components are combined.

In addition to any of the above embodiments, the weight ratio of the α-glucan substrate backbone to sucrose present in the reaction ranges from 0.01:1 to 1:0.01.

In another embodiment, a method is provided to make a blended carbohydrate composition comprising combining the soluble α-glucan fiber composition of the first embodiment with: a monosaccharide, a disaccharide, glucose, sucrose, fructose, leucrose, corn syrup, high fructose corn syrup, isomerized sugar, maltose, trehalose, panose, raffinose, cellobiose, isomaltose, honey, maple sugar, a fruit-derived sweetener, sorbitol, maltitol, isomaltitol, lactose, nigerose, kojibiose, xylitol, erythritol, dihydrochalcone, stevioside, α-glycosyl stevioside, acesulfame potassium, alitame, neotame, glycyrrhizin, thaumantin, sucralose, L-aspartyl-L-phenylalanine methyl ester, saccharine, maltodextrin, starch, potato starch, tapioca starch, dextran, soluble corn fiber, a resistant maltodextrin, a branched maltodextrin, inulin, polydextrose, a fructooligosaccharide, a galactooligosaccharide, a xylooligosaccharide, an arabinoxylooligosaccharide, a nigerooligosaccharide, a gentiooligosaccharide, hemicellulose, fructose oligomer syrup, an isomaltooligosaccharide, a filler, an excipient, a binder, or any combination thereofthereof.

In another embodiment, a method to make a food product, personal care product, or pharmaceutical product is provided comprising mixing one or more edible food ingredients, cosmetically acceptable ingredients or pharmaceutically acceptable ingredients; respectively, with the soluble α-glucan fiber composition of the first embodiment, the carbohydrate composition of the second embodiment, or a combination thereof.

In another embodiment, a method to reduce the glycemic index of a food or beverage is provided comprising incorporating into the food or beverage the soluble α-glucan fiber composition of the first embodiment.

In another embodiment, a method of inhibiting the elevation of blood-sugar level, lowering lipids in the living body, treating constipation or reducing gastrointestinal transit time in a mammal is provided comprising a step of administering the soluble α-glucan fiber composition of the first embodiment to the mammal.

In another embodiment, a method to alter fatty acid production in the colon of a mammal is provided the method comprising a step of administering the present soluble α-glucan fiber composition of to the mammal; preferably wherein the short chain fatty acid production is increased and/or the branched chain fatty acid production is decreased.

In another embodiment, a use of the soluble α-glucan fiber composition of the first embodiment in a food composition suitable for consumption by animals, including humans is also provided.

A composition or method according to any of the above embodiments wherein the α-glucan fiber composition comprises less than 10%, preferably less than 5 wt %, and most preferably 1 wt % or less reducing sugars.

A composition or method according to any of the above embodiments wherein the soluble α-glucan fiber composition is characterized by a number average molecular weight (Mn) between 1500 and 90,000 g/mol, preferably 1500 to 30,000 g/mol, more preferably 1500 to 20,000, and more preferably 3000 to 16000 g/mol.

A composition or method according to any of the above embodiments wherein the carbohydrate composition comprises: a monosaccharide, a disaccharide, glucose, sucrose, fructose, leucrose, corn syrup, high fructose corn syrup, isomerized sugar, maltose, trehalose, panose, raffinose, cellobiose, isomaltose, honey, maple sugar, a fruit-derived sweetener, sorbitol, maltitol, isomaltitol, lactose, nigerose, kojibiose, xylitol, erythritol, dihydrochalcone, stevioside, α-glycosyl stevioside, acesulfame potassium, alitame, neotame, glycyrrhizin, thaumantin, sucralose, L-aspartyl-L-phenylalanine methyl ester, saccharine, maltodextrin, starch, potato starch, tapioca starch, dextran, soluble corn fiber, a resistant maltodextrin, a branched maltodextrin, inulin, polydextrose, a fructooligosaccharide, a galactooligosaccharide, a xylooligosaccharide, an arabinoxylooligosaccharide, a nigerooligosaccharide, a gentiooligosaccharide, hem icellulose, fructose oligomer syrup, an isomaltooligosaccharide, a filler, an excipient, a binder, or any combination thereofthereof.

A composition or method according to any of the above embodiments wherein the carbohydrate composition is in the form of a liquid, a syrup, a powder, granules, shaped spheres, shaped sticks, shaped plates, shaped cubes, tablets, powders, capsules, sachets, or any combination thereof.

A composition or method according to any of the above embodiments wherein the food product is
  a. a bakery product selected from the group consisting of cakes, brownies, cookies, cookie crisps, muffins, breads, and sweet doughs, extruded cereal pieces, and coated cereal pieces;
  b. a dairy product selected from the group consisting of yogurt, yogurt drinks, milk drinks, flavored milks, smoothies, ice cream, shakes, cottage cheese, cottage cheese dressing, quarg, and whipped mousse-type products;
  c. confections selected from the group consisting of hard candies, fondants, nougats and marshmallows, gelatin jelly candies, gummies, jellies, chocolate, licorice, chewing gum, caramels, toffees, chews, mints, tableted confections, and fruit snacks;
  d. beverages selected from the group consisting of carbonated beverages, fruit juices, concentrated juice mixes, clear waters, and beverage dry mixes;
  e. high solids fillings for snack bars, toaster pastries, donuts, or cookies;
  f. extruded and sheeted snacks selected from the group consisting of puffed snacks, crackers, tortilla chips, and corn chips;
  g. snack bars, nutrition bars, granola bars, protein bars, and cereal bars;
  h. cheeses, cheese sauces, and other edible cheese products;
  i. edible films;
  j. water soluble soups, syrups, sauces, dressings, or coffee creamers; or
  k. dietary supplements; preferably in the form of tablets, powders, capsules or sachets.

A composition comprising 0.01 to 99 wt % (dry solids basis) of the present soluble α-glucan fiber composition and: a synbiotic, a peptide, a peptide hydrolysate, a protein, a protein hydrolysate, a soy protein, a dairy protein, an amino acid, a polyol, a polyphenol, a vitamin, a mineral, an herbal, an herbal extract, a fatty acid, a polyunsaturated fatty acid (PUFAs), a phytosteroid, betaine, a carotenoid, a digestive enzyme, a probiotic organism or any combination thereof.

A method according to any of the above embodiments wherein the isolating step comprises at least one of centrifugation, filtration, fractionation, chromatographic separation, dialysis, evaporation, dilution or any combination thereof.

A method according to any of the above embodiments wherein the glucosyltransferase used to synthesize the α-glucan substrate backbone comprises an amino acid sequence having at least 90% identity to SEQ ID NO: 7, 9, 10, 11, 12, 13, 14 or 16; preferably 7, 9, 10, 11, 12 or 13 when not used with an α-glucanohydrolase.

A method according to any of the above embodiments wherein the α-glucanohydrolase is a dextranase or mutanase.

A method according to any of the above embodiments wherein the maltodextrin substrate concentration is initially at least 20 g/L when the set of reaction components are combined.

A method according to any of the above embodiments wherein the ratio of dextrin dextranase activity to endodextranase activity ranges from 0.01:1 to 1:0.01.

A method according to any of the above embodiments wherein the suitable aqueous reaction conditions comprise a reaction temperature between 0° C. and 45° C.

A method according to any of the above embodiments wherein the suitable aqueous reaction conditions comprise a pH range of 3 to 8; preferably 4 to 8.

A method according to any of the above embodiments wherein the suitable aqueous reaction conditions comprise including a buffer selected from the group consisting of phosphate, pyrophosphate, bicarbonate, acetate, and citrate.

A method according to any of the above embodiments wherein said polypeptide having dextrin dextranase activity comprises an amino acid sequence having at least 90%, preferably at least 91, 92, 93, 94, 95, 96, 97, 98, 99 or 100% identity to SEQ ID NO:26.

A method according to any of the above embodiments wherein said at least one polypeptide comprising α-glucanohydrolase activity comprises dextrinase activity, preferably endodextranase activity, preferably an endodextranase from *Chaetomium erraticum,* more preferably Dextrinase L from *Chaetomium erraticum,* and most preferably DEXTRANASE® Plus L. In a preferred embodiment, the dextranase is suitable for use in foods and is generally recognized as safe (GRAS).

A method according to any of the above embodiments wherein said at least one polypeptide comprising α-glucanohydrolase activity comprises mutanase activity, preferable endomutanase activity, preferably comprising an amino acid sequence having at least 90% identity, preferably 91, 92, 93, 94, 95, 96, 97, 98, 99 or 100% identity to SEQ ID NO: 21 or 23.

A method according to any of the above embodiments wherein said glucosyltransferase comprises an amino acid sequence having at least 90%, preferably at least 91, 92, 93, 94, 95, 96, 97, 98, 99 or 100% identity to SEQ ID NO: 14 or 16 and said endomutanase comprises an amino acid sequence having at least 90%, preferably 91, 92, 93, 94, 95, 96, 97, 98, 99 or 100% identity to SEQ ID NO: 21 or 23.

A method according to any of the above embodiments where the α-glucan substrate backbone is synthesized from maltodextrin using a 4,6-α-glucosyltransferase (Gtf-B type) comprising an amino acid sequence having at least 90% identity; preferably at least 91, 92, 93, 94, 95, 96, 97, 98, 99 or 100% identity to SEQ ID NO: 68, 69 or 70.

A method according to any of the above embodiments wherein the maltodextrin substrate is synthesized using an polypeptide having amylosucrase activity, preferably comprising an amino acid sequence having at least 90% identity, more preferably at least 91, 92, 93, 94, 95, 96, 97, 98, 99 or 100% identity to SEQ ID NO: 71.

A product produced by any of the above process embodiments; preferably wherein the product produced is the soluble α-glucan fiber composition of the first embodiment.

EXAMPLES

Unless defined otherwise herein, all technical and scientific terms used herein have the same meaning as commonly understood by one of ordinary skill in the art to which this invention belongs. Singleton, et al., DICTIONARY OF MICROBIOLOGY AND MOLECULAR BIOLOGY, 2D ED., John Wiley and Sons, New York (1994), and Hale & Marham, THE HARPER COLLINS DICTIONARY OF BIOLOGY, Harper Perennial, N.Y. (1991) provide one of skill with a general dictionary of many of the terms used in this invention.

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

The meaning of abbreviations is as follows: "sec" or "s" means second(s), "ms" mean milliseconds, "min" means minute(s), "h" or "hr" means hour(s), "μL" means microliter(s), "mL" means milliliter(s), "L" means liter(s); "mL/min" is milliliters per minute; "μg/mL" is microgram(s) per milliliter(s); "LB" is Luria broth; "μm" is micrometers, "nm" is nanometers; "OD" is optical density; "IPTG" is isopropyl-β-D-thio-galactoside; "g" is gravitational force; "mM" is millimolar; "SDS-PAGE" is sodium dodecyl sulfate polyacrylamide; "mg/mL" is milligrams per milliliters; "N" is normal; "w/v" is weight for volume; "DTT" is dithiothreitol; "BCA" is bicinchoninic acid; "DMAc" is N, N'-dimethyl acetamide; "LiCl" is Lithium chloride' "NMR" is nuclear magnetic resonance; "DMSO" is dim ethylsulfoxide; "SEC" is size exclusion chromatography; "GI" or "gi" means GenInfo Identifier, a system used by GENBANK® and other sequence databases to uniquely identify polynucleotide and/or polypeptide sequences within the respective databases; "DPx" means glucan degree of polymerization having "x" units in length; "ATCC" means American Type Culture Collection (Manassas, Va.), "DSMZ" and "DSM" will refer to Leibniz Institute DSMZ-German Collection of Microorganisms and Cell Cultures, (Braunschweig, Germany); "EELA" is the Finish Food Safety Authority (Helsinki, Finland;) "CCUG" refer to the Culture Collection, University of Goteborg, Sweden; "Suc." means sucrose; "Gluc." means glucose; "Fruc." means fructose; "Leuc." means leucrose; and "Rxn" means reaction.

General Methods

Standard recombinant DNA and molecular cloning techniques used herein are well known in the art and are described by Sambrook, J. and Russell, D., Molecular Cloning: A Laboratory Manual, Third Edition, Cold Spring Harbor Laboratory Press, Cold Spring Harbor, N.Y. (2001); and by Silhavy, T. J., Bennan, M. L. and Enquist, L. W., Experiments with Gene Fusions, Cold Spring Harbor Laboratory Cold Press Spring Harbor, NY (1984); and by Ausubel, F. M. et. al., Short Protocols in Molecular Biology, 5$^{th}$ Ed. Current Protocols and John Wiley and Sons, Inc., N.Y., 2002.

Materials and methods suitable for the maintenance and growth of bacterial cultures are also well known in the art. Techniques suitable for use in the following Examples may be found in Manual of Methods for General Bacteriology, Phillipp Gerhardt, R. G. E. Murray, Ralph N. Costilow, Eugene W. Nester, Willis A. Wood, Noel R. Krieg and G. Briggs Phillips, eds., (American Society for Microbiology Press, Washington, D.C. (1994)), Biotechnology: A Textbook of Industrial Microbiology by Wulf Crueger and Anneliese Crueger (authors), Second Edition, (Sinauer Associates, Inc., Sunderland, Mass. (1990)), and Manual of Industrial Microbiology and Biotechnology, Third Edition, Richard H. Baltz, Arnold L. Demain, and Julian E. Davis (Editors), (American Society of Microbiology Press, Washington, D.C. (2010).

All reagents, restriction enzymes and materials used for the growth and maintenance of bacterial cells were obtained from BD Diagnostic Systems (Sparks, Md.), Invitrogen/Life Technologies Corp. (Carlsbad, Calif.), Life Technologies (Rockville, Md.), QIAGEN (Valencia, Calif.), Sigma-Aldrich Chemical Company (St. Louis, Mo.) or Pierce Chemical Co. (A division of Thermo Fisher Scientific Inc., Rockford, Ill.) unless otherwise specified. IPTG, (cat#16758) and triphenyltetrazolium chloride were obtained from the Sigma Co., (St. Louis, Mo.). Bellco spin flask was from the Bellco Co., (Vineland, N.J.). LB medium was from Becton, Dickinson and Company (Franklin Lakes, N.J.). BCA protein assay was from Sigma-Aldrich (St Louis, Mo.).

Growth of Recombinant E. coli Strains for Production of GTF Enzymes

Escherichia coli strains expressing a functional GTF enzyme were grown in shake flask using LB medium with ampicillin (100 μg/mL) at 37° C. and 220 rpm to $OD_{600\,nm}$=0.4-0.5, at which time isopropyl-β-D-thio-galactoside (IPTG) was added to a final concentration of 0.5 mM and incubation continued for 2-4 hr at 37° C. Cells were harvested by centrifugation at 5,000×g for 15 min and resuspended (20%-25% wet cell weight/v) in 50 mM phosphate buffer pH 7.0). Resuspended cells were passed through a French Pressure Cell (SLM Instruments, Rochester, N.Y.) twice to ensure >95% cell lysis. Cell lysate was centrifuged for 30 min at 12,000×g and 4° C. The resulting supernatant (cell extract) was analyzed by the BCA protein assay and SDS-PAGE to confirm expression of the GTF enzyme, and the cell extract was stored at −80° C.

pHYT Vector

The pHYT vector backbone is a replicative Bacillus subtilis expression plasmid containing the Bacillus subtilis aprE promoter. It was derived from the Escherichia coli-Bacillus subtilis shuttle vector pHY320PLK (GENBANK® Accession No. D00946 and is commercially available from Takara Bio Inc. (Otsu, Japan)). The replication origin for Escherichia coli and ampicillin resistance gene are from pACYC177 (GENBANK® X06402 and is commercially available from New England Biolabs Inc., Ipswich, Mass.). The replication origin for Bacillus subtilis and tetracycline resistance gene were from pAMalpha-1 (Francia et al., J Bacteriol. 2002 September; 184(18):5187-93)). To construct pHYT, a terminator sequence: 5'-ATAAAAAACGCTCG-GTTGCCGCCGGGCGTTTTTTAT-3' (SEQ ID NO: 32) from phage lambda was inserted after the tetracycline resistance gene. The entire expression cassette (EcoRI-BamHI fragment) containing the aprE promoter-AprE signal peptide sequence-coding sequence encoding the enzyme of interest (e.g., coding sequences for various GTFs)-BPN' terminator was cloned into the EcoRI and HindIII sites of pHYT using a BamHI-HindIII linker that destroyed the HindIII site. The linker sequence is 5'-GGATCCTGACTGCCTGAGCTT-3' (SEQ ID NO: 33). The aprE promoter and AprE signal peptide sequence (SEQ ID NO: 34) are native to *Bacillus subtilis*. The BPN' terminator is from subtilisin of *Bacillus amyloliquefaciens*. In the case when native signal peptide was used, the AprE signal peptide was replaced with the native signal peptide of the expressed gene.

Biolistic Transformation of *T. reesei*

A *Trichoderma reesei* spore suspension was spread onto the center ~6 cm diameter of an acetamidase transformation plate (150 μL of a $5\times10^7$-$5\times10^8$ spore/mL suspension). The plate was then air dried in a biological hood. The stopping screens (BioRad 165-2336) and the macrocarrier holders (BioRad 1652322) were soaked in 70% ethanol and air dried. DRIERITE® desiccant (calcium sulfate desiccant; W.A. Hammond DRIERITE® Company, Xenia, Ohio) was placed in small Petri dishes (6 cm Pyrex) and overlaid with Whatman filter paper (GE Healthcare Bio-Sciences, Pittsburgh, Pa.). The macrocarrier holder containing the macrocarrier (BioRad 165-2335; Bio-Rad Laboratories, Hercules, Calif.) was placed flatly on top of the filter paper and the Petri dish lid replaced. A tungsten particle suspension was prepared by adding 60 mg tungsten M-10 particles (microcarrier, 0.7 micron, BioRad #1652266, Bio-Rad Laboratories) to an Eppendorf tube. Ethanol (1 mL) (100%) was added. The tungsten was vortexed in the ethanol solution and allowed to soak for 15 minutes. The Eppendorf tube was microfuged briefly at maximum speed to pellet the tungsten. The ethanol was decanted and washed three times with sterile distilled water. After the water wash was decanted the third time, the tungsten was resuspended in 1 mL of sterile 50% glycerol. The transformation reaction was prepared by adding 25 μL suspended tungsten to a 1.5 mL-Eppendorf tube for each transformation. Subsequent additions were made in order, 2 μL DNA pTrex3 expression vectors (SEQ ID NO: 24; see U.S. Pat. No. 6,426,410), 25 μL 2.5M CaCl2, 10 μL 0.1M sperm idine. The reaction was vortexed continuously for 5-10 minutes, keeping the tungsten suspended. The Eppendorf tube was then microfuged briefly and decanted. The tungsten pellet was washed with 200 μL of 70% ethanol, microfuged briefly to pellet and decanted. The pellet was washed with 200 μL of 100% ethanol, microfuged briefly to pellet, and decanted. The tungsten pellet was resuspended in 24 μL 100% ethanol. The Eppendorf tube was placed in an ultrasonic water bath for 15 seconds and 8 μL aliquots were transferred onto the center of the desiccated macrocarriers. The macrocarriers were left to dry in the desiccated Petri dishes.

A Helium tank was turned on to 1500 psi (~10.3 MPa). 1100 psi (~7.58 MPa) rupture discs (BioRad 165-2329) were used in the Model PDS-1000/He™ BIOLISTIC® Particle Delivery System (BioRad). When the tungsten solution was dry, a stopping screen and the macrocarrier holder were inserted into the PDS-1000. An acetamidase plate, containing the target *T. reesei* spores, was placed 6 cm below the stopping screen. A vacuum of 29 inches Hg (~98.2 kPa) was pulled on the chamber and held. The He BIOLISTIC® Particle Delivery System was fired. The chamber was vented and the acetamidase plate removed for incubation at 28° C. until colonies appeared (5 days).

Modified amdS Biolistic Agar (MABA) Per Liter
Part I, make in 500 mL distilled water (dH$_2$O)
1000× salts 1 mL
Noble agar 20 g
pH to 6.0, autoclave
Part II, make in 500 mL dH$_2$O
Acetamide 0.6 g
CsCl 1.68 g
Glucose 20 g
KH$_2$PO$_4$ 15 g
MgSO$_4$.7H$_2$O 0.6 g
CaCl$_2$.2H$_2$O 0.6 g
pH to 4.5, 0.2 micron filter sterilize; leave in 50° C. oven to warm, add to agar, mix, pour plates. Stored at room temperature (~21° C.)
1000× Salts Per Liter
FeSO$_4$.7H$_2$O 5 g
MnSO$_4$.H$_2$O 1.6 g
ZnSO$_4$.7H$_2$O 1.4 g
CoCl$_2$.6H$_2$O 1 g
Bring up to 1 L dH$_2$O.
0.2 micron filter sterilize Determination of the Glucosyltransferase Activity Glucosyltransferase activity assay was performed by incubating 1-10% (v/v) crude protein extract containing GTF enzyme with 200 g/L sucrose in 25 mM or 50 mM sodium acetate buffer at pH 5.5 in the presence or absence of 25 g/L dextran (MW ~1500, Sigma-Aldrich, Cat.#31394) at 37° C. and 125 rpm orbital shaking. One aliquot of reaction mixture was withdrawn at 1 h, 2 h and 3 h and heated at 90° C. for 5 min to inactivate the GTF. The insoluble material was removed by centrifugation at 13,000×g for 5 min, followed by filtration through 0.2 μm RC (regenerated cellulose) membrane. The resulting filtrate was analyzed by HPLC using two Aminex HPX-87C columns series at 85° C. (Bio-Rad, Hercules, Calif.) to quantify sucrose concentration. The sucrose concentration at each time point was plotted against the reaction time and the initial reaction rate was determined from the slope of the linear plot. One unit of GTF activity was defined as the amount of enzyme needed to consume one micromole of sucrose in one minute under the assay condition.

Determination of the α-Glucanohydrolase Activity

Insoluble mutan polymers required for determining mutanase activity were prepared using secreted enzymes produced by *Streptococcus sobrinus* ATCC® 33478™. Specifically, one loop of glycerol stock of *S. sobrinus* ATCC® 33478™ was streaked on a BHI agar plate (Brain Heart Infusion agar, Teknova, Hollister, Calif.), and the plate was incubated at 37° C. for 2 days; A few colonies were picked using a loop to inoculate 2×100 mL BHI liquid medium in the original medium bottle from Teknova, and the culture was incubated at 37° C., static for 24 h. The resulting cells were removed by centrifugation and the resulting supernatant was filtered through 0.2 μm sterile filter; 2×101 mL of filtrate was collected. To the filtrate was added 2×11.2 mL of 200 g/L sucrose (final sucrose 20 g/L). The reaction was incubated at 37° C., with no agitation for 67 h. The resulting polysaccharide polymers were collected bycentrifugation at 5000×g for 10 min. The supernatant was carefully decanted. The insoluble polymers were washed 4 times with 40 mL of sterile water. The resulting mutan polymers were lyophilized for 48 h. Mutan polymer (390 mg) was suspended in 39 mL of sterile water to make suspension of 10 mg/mL. The mutan suspension was homogenized by sonication (40% amplitude until large lumps disappear, ~10 min in total). The homogenized suspension was aliquoted and stored at 4° C.

A mutanase assay was initiated by incubating an appropriate amount of enzyme with 0.5 mg/mL mutan polymer (prepared as described above) in 25 mM KOAc buffer at pH 5.5 and 37° C. At various time points, an aliquot of reaction mixture was withdrawn and quenched with equal volume of 100 mM glycine buffer (pH 10). The insoluble material in each quenched sample was removed by centrifugation at 14,000×g for 5 min. The reducing ends of oligosaccharide and polysaccharide polymer produced at each time point were quantified by the p-hydroxybenzoic acid hydrazide solution (PAHBAH) assay (Lever M., *Anal. Biochem.*, (1972) 47:273-279) and the initial rate was determined from the slope of the linear plot of the first three or four time points of the time course. The PAHBAH assay was performed by adding 10 μL of reaction sample supernatant to 100 μL of PAHBAH working solution and heated at 95° C. for 5 min. The working solution was prepared by mixing one part of reagent A (0.05 g/mL p-hydroxy benzoic acid hydrazide and 5% by volume of concentrated hydrochloric acid) and four parts of reagent B (0.05 g/mL NaOH, 0.2 g/mL sodium potassium tartrate). The absorption at 410 nm was recorded and the concentration of the reducing ends was calculated by subtracting appropriate background absorption and using a standard curve generated with various concentrations of glucose as standards.

Determination of Glycosidic Linkages

One-dimensional $^1$H NMR data were acquired on a Varian Unity Inova system (Agilent Technologies, Santa Clara, Calif.) operating at 500 MHz using a high sensitivity cryoprobe. Water suppression was obtained by carefully placing the observe transmitter frequency on resonance for the residual water signal in a "presat" experiment, and then using the "tnnoesy" experiment with a full phase cycle (multiple of 32) and a mix time of 10 ms.

Typically, dried samples were taken up in 1.0 mL of $D_2O$ and sonicated for 30 min. From the soluble portion of the sample, 100μL was added to a 5 mm NMR tube along with 350 μL $D_2O$ and 100 μL of $D_2O$ containing 15.3 mM DSS (4,4-dimethyl-4-silapentane-1-sulfonic acid sodium salt) as internal reference and 0.29% $NaN_3$ as bactericide. The abundance of each type of anomeric linkage was measured by the integrating the peak area at the corresponding chemical shift. The percentage of each type of anomeric linkage was calculated from the abundance of the particular linkage and the total abundance anomeric linkages from oligosaccharides.

Methylation Analysis

The distribution of glucosidic linkages in glucans was determined by a well-known technique generally named "methylation analysis," or "partial methylation analysis" (see: F. A. Pettolino, et al., *Nature Protocols*, (2012) 7(9): 1590-1607). The technique has a number of minor variations but always includes: 1. methylation of all free hydroxyl groups of the glucose units, 2. hydrolysis of the methylated glucan to individual monomer units, 3. reductive ring-opening to eliminate anomers and create methylated glucitols; the anomeric carbon is typically tagged with a deuterium atom to create distinctive mass spectra, 4. acetylation of the free hydroxyl groups (created by hydrolysis and ring opening) to create partially methylated glucitol acetates, also known as partially methylated products, 5. analysis of the resulting partially methylated products by gas chromatography coupled to mass spectrometry and/or flame ionization detection.

The partially methylated products include non-reducing terminal glucose units, linked units and branching points. The individual products are identified by retention time and mass spectrometry. The distribution of the partially-methylated products is the percentage (area %) of each product in the total peak area of all partially methylated products. The gas chromatographic conditions were as follows: RTx-225 column (30 m×250 μm ID×0.1 μm film thickness, Restek Corporation, Bellefonte, Pa., USA), helium carrier gas (0.9 mL/min constant flow rate), oven temperature program starting at 80° C. (hold for 2 min) then 30° C./min to 170° C. (hold for 0 min) then 4° C./min to 240° C. (hold for 25 min), 1 μL injection volume (split 5:1), detection using electron impact mass spectrometry (full scan mode)

Viscosity Measurement

The viscosity of 12 wt % aqueous solutions of soluble fiber was measured using a TA Instruments AR-G2 controlled-stress rotational rheometer (TA Instruments—Waters, LLC, New Castle, Del.) equipped with a cone and plate geometry. The geometry consists of a 40 mm 2° upper cone and a peltier lower plate, both with smooth surfaces. An environmental chamber equipped with a water-saturated sponge was used to minimize solvent (water) evaporation during the test. The viscosity was measured at 20° C. The peltier was set to the desired temperature and 0.65 mL of sample was loaded onto the plate using an Eppendorf pipette (Eppendorf North America, Hauppauge, N.Y.). The cone was lowered to a gap of 50 μm between the bottom of the cone and the plate. The sample was thermally equilibrated for 3 minutes. A shear rate sweep was performed over a shear rate range of 500-10 $s^{-1}$. Sample stability was confirmed by running repeat shear rate points at the end of the test.

Determination of the Concentration of Sucrose, Glucose, Fructose and Leucrose

Sucrose, glucose, fructose, and leucrose were quantitated by HPLC with two tandem Aminex HPX-87C Columns (Bio-Rad, Hercules, Calif.). Chromatographic conditions used were 85° C. at column and detector compartments, 40° C. at sample and injector compartment, flow rate of 0.6 mL/min, and injection volume of 10 μL. Software packages used for data reduction were EMPOWER™ version 3 from Waters (Waters Corp., Milford, Mass.). Calibrations were performed with various concentrations of standards for each individual sugar.

Determination of the Concentration of Oligosaccharides

Soluble oligosaccharides were quantitated by HPLC with two tandem Aminex HPX-42A columns (Bio-Rad). Chromatographic conditions used were 85° C. column temperature and 40° C. detector temperature, water as mobile phase (flow rate of 0.6 mL/min), and injection volume of 10 μL. Software package used for data reduction was EMPOWER-™version 3 from Waters Corp. Oligosaccharide samples from DP2 to DP7 were obtained from Sigma-Aldrich: maltoheptaose (DP7, Cat. #47872), maltohexanose (DP6, Cat. #47873), maltopentose (DP5, Cat. #47876), maltotetraose (DP4, Cat.# 47877), isomaltotriose (DP3, Cat. #47884) and maltose (DP2, Cat. #47288). Calibration was performed for each individual oligosaccharide with various concentrations of the standard.

Determination of Digestibility

The digestibility test protocol was adapted from the Megazyme Integrated Total Dietary Fiber Assay (AOAC method 2009.01, Ireland). The final enzyme concentrations were kept the same as the AOAC method: 50 Unit/mL of pancreatic α-amylase (PAA), 3.4 Units/mL for amyloglucosidase (AMG). The substrate concentration in each reaction was 25 mg/mL as recommended by the AOAC method. The total volume for each reaction was 1 mL instead of 40 mL as suggested by the original protocol. Every sample was analyzed in duplicate with and without the treatment of the two digestive enzymes. The detailed procedure is described below:

The enzyme stock solution was prepared by dissolving 20 mg of purified porcine pancreatic α-amylase (150,000 Units/g; AOAC Method 2002.01) from the Integrated Total Dietary Fiber Assay Kit in 29 mL of sodium maleate buffer (50 mM, pH 6.0 plus 2 mM CaCl2) and stir for 5 min, followed by the addition of 60 uL amyloglucosidase solution (AMG, 3300 Units/mL) from the same kit. 0.5 mL of the enzyme stock solution was then mixed with 0.5 mL soluble fiber sample (50 mg/mL) in a glass vial and the digestion reaction mixture was incubated at 37° C. and 150 rpm in orbital motion in a shaking incubator for exactly 16 h. Duplicated reactions were performed in parallel for each fiber sample. The control reactions were performed in duplicate by mixing 0.5 mL maleate buffer (50 mM, pH 6.0 plus 2 mM CaCl2) and 0.5 mL soluble fiber sample (50 mg/mL) and reaction mixtures was incubated at 37° C. and 150 rpm in orbital motion in a shaking incubator for exactly 16 h. After 16 h, all samples were removed from the incubator and immediately 75 µL of 0.75 M TRIZMA® base solution was added to terminate the reaction. The vials were immediately placed in a heating block at 95-100° C., and incubate for 20 min with occasional shaking (by hand). The total volume of each reaction mixture is 1.075 mL after quenching. The amount of released glucose in each reaction was quantified by HPLC with the Aminex HPX-87C Columns (BioRad) as described in the General Methods. Maltodextrin (DE4-7, Sigma) was used as the positive control for the enzymes. To calculate the digestibility, the following formula was used: Digestibility=100%*[amount of glucose (mg) released after treatment with enzyme−amount of glucose (mg) released in the absence of enzyme]/1.1*amount of total fiber (mg)"

Purification of Soluble Oligosaccharide Fiber

Soluble oligosaccharide fiber present in product mixtures produced by the conversion of sucrose using glucosyltransferase enzymes with or without added mutanases as described in the following examples were purified and isolated by size-exclusion column chromatography (SEC). In a typical procedure, product mixtures were heat-treated at 60° C. to 90° C. for between 15 min and 30 min and then centrifuged at 4000 rpm for 10 min. The resulting supernatant was injected onto an AKTAprime purification system (SEC; GE Healthcare Life Sciences) (10 mL-50 mL injection volume) connected to a GE HK 50/60 column packed with 1.1 L of Bio-Gel P2 Gel (Bio-Rad, Fine 45-90 µm) using water as eluent at 0.7 mL/min. The SEC fractions (~5 mL per tube) were analyzed by HPLC for oligosaccharides using a Bio-Rad HPX-47A column. Fractions containing >DP2 oligosaccharides were combined and the soluble fiber isolated by rotary evaporation of the combined fractions to produce a solution containing between 3% and 6% (w/w) solids, where the resulting solution was lyophilized to produce the soluble fiber as a solid product.

Pure Culture Growth on Specific Carbon Sources

To test the capability of microorganisms to grow on specific carbon sources (oligosaccharide or polysaccharide soluble fibers), selected microbes were grown in appropriate media free from carbon sources other than the ones under study. Growth was evaluated by regular (every 30 min) measurement of optical density at 600 nm in an anaerobic environment (80% $N_2$, 10% $CO_2$, 10% $H_2$). Growth was expressed as area under the curve and compared to a positive control (glucose) and a negative control (no added carbon source).

Stock solutions of oligosaccharide soluble fibers (10% w/w) were prepared in demineralised water. The solutions were either sterilised by UV radiation or filtration (0.2 µm). Stocks were stored frozen until used. Appropriate carbon source-free medium was prepared from single ingredients. Test organisms were pre-grown anaerobically in the test medium with the standard carbon source. In honeycomb wells, 20 µL of stock solution was pipetted and 180 µL carbon source-free medium with 1% test microbe was added. As positive control, glucose was used as carbon source, and as negative control, no carbon source was used. To confirm sterility of the stock solutions, uninocculated wells were used. At least three parallel wells were used per run.

The honeycomb plates were placed in a Bioscreen and growth was determined by measuring absorbance at 600 nm. Measurements were taken every 30 min and before measurements, the plates were shaken to assure an even suspension of the microbes. Growth was followed for 24 h. Results were calculated as area under the curve (i.e., $OD_{600}$/24 h). Organisms tested (and their respective growth medium) were: *Clostridium perfringens* ATCC® 3626™ (anaerobic Reinforced Clostridial Medium (from Oxoid Microbiology Products, ThermoScientific) without glucose), *Clostridium difficile* DSM 1296 (Deutsche Sammlung von Mikroorganismen and Zellkulturen DSMZ, Braunschweig, Germany) (anaerobic Reinforced *Clostridial Medium* (from Oxoid Microbiology Products, Thermo Fisher Scientific Inc., Waltham, Mass.) without glucose), *Escherichia coli* ATCC® 11775™ (anaerobic Trypticase Soy Broth without glucose), *Salmonella typhimurium* EELA (available from DSMZ, Brauchschweig, Germany) (anaerobic Trypticase Soy Broth without glucose), *Lactobacillus acidophilus* NCFM 145 (anaerobic de Man, Rogosa and Sharpe Medium (from DSMZ) without glucose), *Bifidobacterium animalis* subsp. *Lactis* Bi-07 (anaerobic Deutsche Sammlung vom Mikroorgnismen and Zellkulturen medium 58 (from DSMZ), without glucose).

In Vitro Gas Production

To measure the formation of gas by the intestinal microbiota, a pre-conditioned faecal slurry was incubated with test prebiotic (oligosaccharide or polysaccharide soluble fibers) and the volume of gas formed was measured. Fresh faecal material was pre-conditioned by dilution with 3 parts (w/v) of anaerobic simulator medium, stirring for 1 h under anaerobic conditions and filtering through 0.3-mm metal mesh after which it was incubated anaerobically for 24 h at 37° C.

The simulator medium used was composed as described by G. T. Macfarlane et al. (*Microb. Ecol.* 35(2):180-7 (1998)) containing the following constituents (g/L) in distilled water: starch (BDH Ltd.), 5.0; peptone, 0.05; tryptone, 5.0; yeast extract, 5.0; NaCl, 4.5; KCl, 4.5; mucin (porcine gastric type III), 4.0; casein (BDH Ltd.), 3.0; pectin (citrus), 2.0; xylan (oatspelt), 2.0; arabinogalactan (larch wood), 2.0; $NaHCO_3$, 1.5; $MgSO_4$, 1.25; guar gum, 1.0; inulin, 1.0; cysteine, 0.8; $KH_2PO_4$, 0.5; $K_2HPO_4$, 0.5; bile salts No. 3, 0.4; $CaCl_2 \times 6$ $H_2O$, 0.15; $FeSO_4 \times 7$ $H_2O$, 0.005; hemin, 0.05; and Tween 80, 1.0; cysteine hydrochloride, 6.3; $Na_2S \times 9$ $H_2O$, and 0.1% resazurin as an indication of sustained anaerobic conditions. The simulation medium was filtered through 0.3 mm metal mesh and divided into sealed serum bottles.

Test prebiotics were added from 10% (w/w) stock solutions to a final concentration of 1%. The incubation was performed at 37° C. while maintaining anaerobic conditions. Gas production due to microbial activity was measured manually after 24 h incubation using a scaled, airtight glass syringe, thereby also releasing the overpressure from the simulation unit.

Example 1

Expression of Truncated Glucosyltransferase in *E. coli* Having α-(1,2) Branching Activity The following example describes expression of a full length glucosyltransferase and a truncated version of this enzyme in *E. coli* and tested their α-(1,2) branching activity on a glucan backbone. The full length glucosyltransferase produced glucan with little α-(1,2) branching. The truncated version of the glucosyltransferase produced glucan with significant amount of α-(1,2) branching.

The putative glucosyltransferase (GENBANK® gi: 356644413) from *Leuconostoc mesenteroides* subsp. *mesenteroides* J18 (designated as GtfJ18) has 2771 amino acids (SEQ ID NO: 1). It was identified as a glycosyl hydrolase from complete genome sequencing of the J18 strain isolated from Kimchi (Jung et al., *J. Bacteriol.* 194:730 (2012)). The full length sequence of GtfJ18 (2771 amino acids in length) has 68.6% amino acid identity to the DsrE protein (2835 amino acids in length; SEQ ID NO: 2) from *Leuconostoc mesenteroides* NRRL B-1299 (GENBANK® gi: 23320943).

The DsrE protein was previously the only enzyme in the GH70 family of glucosyltransferases shown to be a bifunctional protein with two catalytic domains (Bozonnet et al., *J. Bacteriol.* 184:5763 (2002)). The first catalytic domain "CD1" catalyzes the synthesis of the α-(1,6) linkages and the second catalytic domain "CD2" catalyzes the synthesis of the α-(1,2) linkages. The CD1 and CD2 domains were separated by a glucan binding domain "GBD" (Fabre et al., *J. Bacteriol.* 187:296 (2005)). The CD1 domains of the DsrE and GtfJ18 share 79.3% amino acid identity and the CD2 domains of the two proteins share 76.6% amino acid identity.

The N-terminal 20 amino acids segment of GtfJ18 was deduced as the signal peptide by the SignalP 4.0 program (Petersen et al., *Nature Methods*, 8:785-786, (2011)). To construct the full length gtfJ18 expression plasmid, the DNA (SEQ ID NO: 3) encoding the mature protein without the signal peptide (SEQ ID NO: 4) was synthesized by GenScript USA Inc. (Piscataway, N.J.). The synthesized gene was subcloned into the NheI and HindIII sites of the pET23D+ vector (NOVAGEN®; Merck KGaA, Darmstadt, Germany). A polynucleotide (SEQ ID NO: 5) encoding a truncated version of gtfJ18 (SEQ ID NO: 6) containing the C-terminal CD2 domain and part of a GBD domain (amino acid residues 1664-2771 of SEQ ID NO: 1) was also subcloned into the pET23D+ vector. The plasmids expressing the full length gtfJ18 gene and the truncated gtfJ18T1 gene were transformed into *E. coli* BL21 DE3 host resulting strains EC0059 and EC0059T1. Cells of EC0059 and EC0059T1 were grown to OD ~0.5 and induced with 1 mM IPTG at 37° C. for 3 hours or alternatively they were induced at 23° C. overnight. The cells were collected by centrifugation at 4000×g for 10 min and resuspended in PBS buffer pH 6.8. The cells were broken by passing through French Press at 14,000 psi (~96.53 MPa) twice and the cell debris was pelleted by centrifugation at 15,000×g for 20 min. The supernatant of the crude enzyme extract was aliquoted and frozen at −80° C.

The activity of each enzyme (EC0059; SEQ ID NO:4) and EC0059T1 (SEQ ID NO: 6) was individually tested with the glucan backbone produced by SG1018. SG1018 is a *Bacillus subtilis* BG6006 strain with 9 protease deletions (amyE:: xylRPxylAcomK-ermC, degUHy32, oppA, ΔspoIIE3501, ΔaprE, ΔnprE, Δepr, ΔispA, Δbpr, Δvpr, ΔwprA, Δmpr-ybfJ, ΔnprB) expressing a glucosyltransferase (GENBANK® gi:357235604) from *Streptococcus criceti* HS-6 (GtfHS-6). The putative glucosyltransferase (GENBANK® gi:357235604; SEQ ID NO: 7) from *Streptococcus criceti* HS-6 (designated as GtfHS6) has 1338 amino acids with the N terminal 36 amino acids deduced as the signal peptide by the SignalP 4.0 program. The full length native coding sequence (SEQ ID NO: 8) with its native signal peptide encoding sequence was synthesized by GenScript and cloned into the SpeI and HindIII sites of the replicative *Bacillus* expression plasmid pHYT (Takara Bio Inc., Otsu, Japan) under the *B. subtilis* aprE promoter. The construct was first transformed into *E. coli* DH10B and selected on ampicillin (100 µg/mL) plates. The confirmed clone pDCQ918 was then transformed into *Bacillus subtilis* BG6006 strain and selected on tetracycline (12.5 µg/mL) plates. SG1018 strain was grown in LB containing 10 µg/mL tetracycline first, and then subcultured into GrantsII medium containing 12.5 µg/mL tetracycline grown at 37° C. for 2-3 days. The cultures were spun at 15,000×g for 30 min at 4° C. and the supernatant was filtered through 0.22 µm filters. The glucan backbone reaction was set up using 10% of the SG1018 supernatant with 100 g/L sucrose, 10 mM sodium citrate pH 5 and 1 mM CaCl₂. All sucrose was consumed after 6 hours at 37° C. and the glucan produced by the glucosyltransferase GtfHS-6 from SG1018 (SEQ ID NO: 7) had molecular weight about 3000 and consisting of almost 100% α-(1,6) linkages. The branching reaction was set up with 70% of the glucan backbone after heat inactivation of the GtfHS-6 at 95° C. for 30 min. The branching enzyme provided as 10% (v/v) of the crude cell extract from EC0059 or EC0059T1 was added with 40 g/L sucrose. The branching reaction was incubated at 37° C. or 30° C. for 22 hours and the products were analyzed by HPLC for sucrose consumption and NMR for linkage profile.

NMR data were acquired on an Agilent DD2 spectrometer (Agilent Technologies, Inc., Santa Clara, Calif.) operating at 500 MHz for $^1H$ using a 5 mm cryogenic triple-resonance pulsed-field gradient probe. Water suppression was obtained by carefully placing the observe transmitter frequency on resonance for the residual water signal in a "presat" experiment, and then using the first slice of a NOESY experiment with a full phase cycle (multiple of 32) and a mix time of 10 ms. One-dimensional $^1H$ spectra were acquired with a spectral width of 6410 Hz, acquisition time of 5.1 s, 65536 data points, 4 s pre-saturation and a 90-degree observe pulse. Signal averaging typically involved accumulation of 64 scans. Sample temperature was maintained at 25° C.

Liquid samples were prepared by adding either 50 or 100 µL to a 5 mm NMR tube along with 60 µL of D₂O containing 12.4 mM 4,4-dimethyl-4-silapentane-1-sulfonic acid sodium salt (DSS) as internal chemical shift reference, and the balance (450 or 400 µL) of D₂O for a total volume of 560 µL. The DSS methyl resonance was set to 0 ppm.

Chemical shift assignments for different anomeric linkages were taken from Goffin et al. (*Bull Korean Chem. Soc.* 30:2535 (2009)). Assignments specific to α-(1,2) branching on an α-(1,6) backbone were taken from Maina et al., (*Carb. Res.* 343:1446 (2008)). Alphα-(1,2) substitution on the (1,6) backbone (alpha 1-2,6 linkage) leads to a characteristic chemical shift (5.18 ppm) for the anomeric H adjacent the substitution site. The anomeric H of the (1-2) linked sugar (5.10 ppm) is obscured by leucrose in reaction mixtures but is directly observed in purified samples.

The product with EC0059 extract (comprising GtfJ18; SEQ ID NO: 4) contained 97% α-(1,6) linkages and only 0.6% α-(1,2) linkages. The product with EC0059T1 extract contained 82% α-(1,6) linkages and 18% α-(1,2) linkages. The truncated GtfJ18T1 (SEQ ID NO: 6) in EC0059T1 showed much higher α-(1,2) branching activity comparing to the full length GtfJ18 in EC0059. Although not bound by theory, it may be that the CD1 domain in the full length GtfJ18 was very active and competed with CD2 branching domain for the needed sucrose.

Example 2

Optimization of the α-(1,2) Branching Activity

The following example describes optimization of the α-(1,2) branching activity of EC0059T1 (SEQ ID NO: 6) with regards to temperature and sucrose concentrations.

The branching enzyme reaction described above with the glucan backbone produced by SG1018 (comprising GTF5604; SEQ ID NO: 7) was set up at 30° C. and at 37° C. with 40 g/L sucrose. The branched products were analyzed by HPLC for sugar concentrations and NMR for linkages. Table 1 shows that at 30° C. almost all sucrose was consumed and achieved 27% α-(1,2) branching on the backbone produced by SG1018, whereas about half of sucrose was not consumed at 37° C. and achieved 18% α-(1,2) branching on the SG1018 backbone. The sucrose control was the negative control with all reaction components except for the branching enzyme. The data indicated that the branching enzyme GTFJ18T1 (SEQ ID NO: 6) is more active at 30° C. than at 37° C.

TABLE 1

Analysis of the α-(1,2) branching reaction products of the SG1018 produced glucan backbone with 40 g/L sucrose at different temperatures

| Samples | HPLC analysis | | | | NMR Analysis (%) | | | |
|---|---|---|---|---|---|---|---|---|
| | Sucrose (g/L) | Leucrose (g/L) | Glucose (g/L) | Fructose (g/L) | α-1,2,6 | α-1,6 | α-1,3 | α-1,3,6 |
| Sucrose control | 43.1 | 16.5 | 6.3 | 50.8 | 0 | 100 | 0 | 0 |
| EC0059T1-37° C. (SEQ ID NO: 6) | 18.6 | 18.7 | 5.6 | 61.5 | 18.4 | 81.6 | 0 | 0 |
| EC0059T1-30° C. (SEQ ID NO: 6) | 0.18 | 20.9 | 6.8 | 67.6 | 27.4 | 72.1 | 0.47 | 0 |

Another experiment was set up with various sucrose concentrations ranging from 2.5 g/L to 40 g/L in the branching reaction at 30° C. Table 2 shows that a higher percentage of α-(1,2) branching was reached with higher sucrose concentrations in the branching reaction. In the case of 40 g/L sucrose, 21.4% of α-(1,2) branching was achieved even though there was still 14.7 g/L sucrose left at the end of the reaction. A new batch of more active branching enzyme was prepared from EC0059T1 (SEQ ID NO: 6) and the branching reaction was repeated with 40 g/L and 80 g/L sucrose. Table 3 shows that when 40 g/L sucrose was all consumed, 24.5% α-(1,2) branching was achieved with SG1018-derived (i.e., glucan background produced using SEQ ID NO: 7) glucan backbone. When 80 g/L sucrose was used, as high as 40% α-(1,2) branching was achieved.

TABLE 2

Analysis of the α-(1,2) branching reaction products of the SG1018 produced glucan backbone at 30° C. with different sucrose concentrations (2.5 g/L-40 g/L)

| Samples | HPLC analysis | | | | | NMR Analysis (%) | | | |
|---|---|---|---|---|---|---|---|---|---|
| | Initial Sucrose (g/L) | Final Sucrose (g/L) | Leucrose (g/L) | Glucose (g/L) | Fructose (g/L) | α-1,2,6 | α-1,6 | α-1,3 | α-1,3,6 |
| EC0059T1 | 40 | 14.7 | 19.2 | 6.6 | 62.6 | 21.4 | 78.6 | 0 | 0 |
| EC0059T1 | 20 | 7.1 | 17.7 | 3 | 63.7 | 13.1 | 86.9 | 0 | 0 |
| EC0059T1 | 10 | 3.4 | 17.5 | 5.2 | 53.7 | 6.1 | 93.9 | 0 | 0 |
| EC0059T1 | 5 | 1.3 | 17.2 | 5.4 | 51.5 | 3.4 | 96.6 | 0 | 0 |
| EC0059T1 | 2.5 | 0.7 | 17 | 5.2 | 50.1 | 1.8 | 98.2 | 0 | 0 |
| Sucrose control | 40 | 43.1 | 16.5 | 6.3 | 50.8 | 0 | 100 | 0 | 0 |

TABLE 3

Analysis of the α-(1,2) branching reaction products of the SG1018 produced glucan backbone at 30° C. with different sucrose concentrations (40 g/L-80 g/L) using a new batch of the branching enzyme

| Samples | HPLC analysis | | | | | NMR Analysis (%) | | | |
|---|---|---|---|---|---|---|---|---|---|
| | Initial Sucrose (g/L) | Final Sucrose (g/L) | Leucrose (g/L) | Glucose (g/L) | Fructose (g/L) | α-1,2,6 | α-1,6 | α-1,3 | α-1,3,6 |
| EC0059T1 | 80 | 2 | 33.1 | 9.2 | 81.3 | 40.1 | 59.9 | 0 | 0 |
| EC0059T1 | 40 | 0.6 | 21.6 | 7.1 | 69.0 | 24.5 | 75.5 | 0 | 0 |
| Sucrose control | 80 | 86.3 | 17.8 | 4.8 | 52.2 | 0 | 100 | 0 | 0 |

Example 3

Addition of α-(1,2) Branching to Different Glucan Backbones Generated from Sucrose The following example describes the evaluation of the α-(1,2) branching activity of EC0059T1 (SEQ ID NO: 6) on different glucan backbones generated from sucrose. The glucan backbones generated from glucosyltransferases and combinations of glucosyltransferases/mutanases have a wide range of different linkages and molecular weights. The α-(1,2) branching enzyme is active on glucans of different molecular weights having predominantly α-(1,6) linkages as well as glucans comprising mixtures of α-(1,6) and α-(1,3) linkages. The α-(1,2) branching enzyme is not active on the glucans having predominantly α-(1,3) linkages.

Six glucan backbones were generated using glucosyltransferases derived from GENBANK® gi numbers as listed in Table 4. The sequences of the glucosyltransferases are provided as follows: SG1006 ("GTF1729"; SEQ ID NO: 9), SG1018 ("GTF1428"; also referred to herein as "GTF5604"; SEQ ID NO: 7), SG1031 ("GTF6831"; SEQ ID NO: 10), SG1051 ("GTF8845"; SEQ ID NO: 11), SG1066 ("GTF0088"; SEQ ID NO: 12), and SG1115 ("GTF8117"; SEQ ID NO: 13). The glucosyltransferases were expressed in *Bacillus subtilis* BG6006 and the glucan backbone synthesis reactions were set up as described in Example 1 for SG1018. All GTFs were expressed as full length mature proteins except for GTF0088 which had an N-terminal truncation. The GTF1729 (SEQ ID NO: 9) (SG1006) and GTF1428 (SEQ ID NO: 7) (SG1018) were expressed with their native signal sequences. The other four GTFs were expressed with the *Bacillus subtilis* derived AprE signal sequence (SEQ ID NO: 34). The reactions started with 200 g/L sucrose at 37° C. and monitored for 1-3 days until sucrose was all consumed. The HPLC analysis of the backbone reactions were shown in Table 4. The backbone reaction products were also analyzed for linkages by NMR and molecular weight by size exclusion chromatography. As shown in Table 4, the backbones generated range from about 1 kD to 40 kD. Some backbones contain predominantly α-(1,6) linkages and some contain mixtures of α-(1,6) and α-(1,3) linkages.

Two glucan backbones were generated using reaction mixtures comprising combinations of at least one glucosyltransferase and at least one mutanase (concomitant GTF/mutanase). The glucans produced by these glucosyltransferases reactions contain a significant amount of α-(1,3) linkages and are usually insoluble. Mutanases with endohydrolytic activity were used to decrease the molecular weights of the α-(1,3) containing glucans to DP<10 to help make them soluble in water. The soluble DP<10 oligosaccharides containing α-(1,3) linkages were purified and used as backbones for the α-(1,2) branching reaction.

The two glucosyltransferases used in the GTF/mutanase reactions were expressed in *E. coli*. The truncated version of a glucosyltransferase enzyme identified in GENBANK® gi:290580544 (GtfB from *Streptococcus mutans* NN2025; full length sequence provided as SEQ ID NO: 14) and a mature form of GENBANK® gi:47527 (full length sequence with signal sequence provided as SEQ ID NO: 17) (GtfJ from *Streptococcus salivarius* ATCC® 25975; signal sequence removed and start codon added) were synthesized using codons optimized for expression in *E. coli* (DNA 2.0 Inc., Menlo Park, Calif.). The polynucleotide (SEQ ID NO: 15) encoding truncated protein derived from GENBANK® gi:290580544 ("GTF0544"; SEQ ID NO: 16) and the polynucleotide (SEQ ID NO: 18) encoding the protein derived from GENBANK® gi:47527 ("GTF7527"; SEQ ID NO: 19) were subcloned into plasmid pJEXPRESS404® to generate the plasmid identified as pMP67 and pMP52, respectively. The plasmid pMP67 was used to transform *E. coli* TOP10 (Thermo Fisher Scientific Inc., Waltham, Mass.). *E. coli* strains TOP10/pMP67 expressing the GtfB enzyme "GTF0544" was grown in LB medium with ampicillin (100 μg/mL) at 37° C. with shaking to $OD_{600\ nm}$=0.4-0.5, at which time isopropyl-β-D-thio-galactoside (IPTG) was added to a final concentration of 0.5 mM and incubation continued for 2-4 hr at 37° C. Cells were harvested by centrifugation at 5,000×g for 15 min and resuspended (20% w/v) in 50 mM phosphate buffer pH 7.0. Resuspended cells were passed through a French Pressure Cell (SLM Instruments, Rochester, N.Y.) twice to ensure >95% cell lysis. Lysed cells were centrifuged for 30 min at 12,000×g at 4° C. The resulting supernatants were stored at −80° C. The pMP52 plasmid was transformed into *E. coli* MG1655 and the resulting MG1655/pMP52 was grown in fermentor to produce GtfJ as follows:

TABLE 4

Analysis of different glucan backbones generated using different glucosyltransferases with 200 g/L sucrose

| Samples | GENBANK® GI number (SEQ ID NO.) | HPLC analysis of glucan backbone | | | | MW (Da) | NMR analysis of glucan backbone (%) | | | |
|---|---|---|---|---|---|---|---|---|---|---|
| | | Sucrose (g/L) | Leucrose (g/L) | Glucose (g/L) | Fructose (g/L) | | α-1,2,6 | α-1,6 | α-1,3 | α-1,3,6 |
| SG1006 | 121729 (SEQ ID NO: 9) | 0.4 | 9.9 | 7.4 | 84.0 | 6322 | 0 | 100 | 0 | 0 |
| SG1018 | 4691428 (SEQ ID NO: 7) | 0.9 | 25.6 | 7.7 | 80.5 | 2964 | 0 | 100 | 0 | 0 |
| SG1031 | 345526831 (SEQ ID NO: 10) | 0.6 | 8.5 | 9.8 | 88.1 | 43232 | 0 | 100 | 0 | 0 |
| SG1051 | 22138845 (SEQ ID NO: 11) | 0.8 | 42.6 | 16.3 | 63.2 | 18938 | 0 | 80.0 | 2.9 | 17.1 |
| SG1066 | 3130088 (SEQ ID NO: 12) | 0.7 | 30.7 | 13 | 77.0 | 1265 | 0 | 85.9 | 12.2 | 1.9 |
| SG1115 | 335358117 (SEQ ID NO: 13) | 0.2 | 6.5 | 7.6 | 0.0 | 25300 | 0 | 100 | 0 | 0 |

Production of Recombinant GTF by Fermentation

Production of the recombinant mature glucosyltransferase Gtf-J in a fermentor was initiated by preparing a pre-seed culture of the *E. coli* strain MG1655/pMP52, expressing the mature Gtf-J enzyme (GI:47527; "GTF7527"; SEQ ID NO:

19). A 10-mL aliquot of the seed medium was added into a 125-mL disposable baffled flask and was inoculated with a 1.0 mL culture of *E. coli* MG1655/pMP52 in 20% glycerol. This culture was allowed to grow at 37° C. while shaking at 300 rpm for 3 h.

A seed culture for starting the fermentor was prepared by charging a 2-L shake flask with 0.5 L of the seed medium. 1.0 mL of the pre-seed culture was aseptically transferred into 0.5 L seed medium in the flask and cultivated at 37° C. and 300 rpm for 5 h. The seed culture was transferred at optical density >2 ($OD_{550}$) to a 14-L fermentor (Braun, Perth Amboy, N.J.) containing 8 L of the fermentor medium described above at 37° C.

Cells of *E. coli* MG1655/pMP52 were allowed to grow in the fermentor and glucose feed (50% w/w glucose solution containing 1% w/w $MgSO_4.7H_2O$) was initiated when glucose concentration in the medium decreased to 0.5 g/L. The feed was started at 0.36 grams feed per minute (g feed/min) and increased progressively each hour to 0.42, 0.49, 0.57, 0.66, 0.77, 0.90, 1.04, 1.21, 1.41 1.63, 1.92, 2.2 g feed/min respectively. The rate remained constant afterwards. Glucose concentration in the medium was monitored using an YSI glucose analyzer (YSI, Yellow Springs, Ohio). When glucose concentration exceeded 0.1 g/L the feed rate was decreased or stopped temporarily. Induction of glucosyltransferase enzyme activity was initiated, when cells reached an $OD_{550}$ of 70, with the addition of 9 mL of 0.5 M IPTG (isopropyl β-D-1-thiogalacto-pyranoside). The dissolved oxygen (DO) concentration was controlled at 25% of air saturation. The DO was controlled first by impeller agitation rate (400 to 1200 rpm) and later by aeration rate (2 to 10 standard liters per minute, slpm). The pH was controlled at 6.8. $NH_4OH$ (14.5% weight/volume, w/v) and $H_2SO_4$ (20% w/v) were used for pH control. The back pressure was maintained at 0.5 bar. At various intervals (20, 25 and 30 hours), 5 mL of Suppressor 7153 antifoam (Cognis Corporation, Cincinnati, Ohio) was added into the fermentor to suppress foaming. Cells were harvested by centrifugation 8 h post IPTG addition and were stored at −80° C. as a cell paste.

Mutanases

A gene encoding a mutanase from *Paenibacillus Humicus* identified in GENBANK® gi:257153264 was synthesized by GenScript (Piscataway, N.J.). The nucleotide sequence (SEQ ID NO: 20) encoding protein sequence (SEQ ID NO: 21) was subcloned into pET24a (Novagen; Merck KGaA, Darmstadt, Germany). The resulting plasmid was transformed into *E. coli* BL21(DE3) (Invitrogen, Carlsbad, Calif.) to generate the strain identified as "SGZY6". The strain was grown at 37° C. with shaking at 220 rpm to $OD_{600}$ of ~0.7, then the temperature was lowered to 18° C. and IPTG was added to a final concentration of 0.4 mM. The culture was grown overnight before harvest by centrifugation at 4000×g. The cell pellet from 600 mL of culture was suspended in 22 mL 50 mM KPi buffer, pH 7.0. Cells were disrupted by French Cell Press (2 passages @ 15,000 psi (~103.4 MPa)); Cell debris was removed by centrifugation (Sorvall SS34 rotor, @13,000 rpm) for 40 min. The supernatant was analyzed by SDS-PAGE to confirm the expression of the mutanase and the crude extract was used for activity assay. The crude extract was stored at −80° C.

A gene encoding the *Penicillium marneffei* ATCC® 18224 mutanase identified in GENBANK® gi:212533325 was synthesized by GenScript (Piscataway, N.J.). The nucleotide sequence (SEQ ID NO: 22) encoding protein sequence (SEQ ID NO: 23) was subcloned into plasmid pTrex3 (SEQ ID NO: 24) at SacII and AscI restriction sites, a vector designed to express the gene of interest in *Trichoderma reesei*, under control of CBHI promoter and terminator, with *Aspergillus niger* acetamidase for selection.

The resulting plasmid was transformed into *T. reesei* by biolistic injections. The detailed method of biolistic transformation is described in International PCT Patent Application Publication WO2009/126773 A1. A 1 cm2 agar plug with spores from a stable clone TRM05-3 was used to inoculate the production media (described below). The culture was grown in the shake flasks for 4-5 days at 28° C. and 220 rpm. To harvest the secreted proteins, the cell mass was first removed by centrifugation at 4000×g for 10 min and the supernatant was filtered through 0.2 μm sterile filters. The expression of mutanase "MUT3325" (SEQ ID NO: 23) was confirmed by SDS-PAGE.

The production media component is listed below.
NREL-Trich Lactose Defined

| Formula | Amount | Units |
|---|---|---|
| ammonium sulfate | 5 | g |
| PIPPS | 33 | g |
| BD Bacto casamino acid | 9 | g |
| $KH_2PO_4$ | 4.5 | g |
| $CaCl_2 \cdot 2H_2O$ | 1.32 | g |
| $MgSO_4 \cdot 7H_2O$ | 1 | g |
| *T. reesei* trace elements | 2.5 | mL |
| NaOH pellet | 4.25 | g |
| Adjust pH to 5.5 with 50% NaOH | | |
| Bring volume to | 920 | mL |
| Add to each aliquot: Foamblast | 5 | Drops |
| Autoclave, then add 20% lactose filter sterilized | 80 | mL |

*T. reesei* Trace Elements

| Formula | Amount | Units |
|---|---|---|
| citric acid•$H_2O$ | 191.41 | g |
| $FeSO_4 \cdot 7H_2O$ | 200 | g |
| $ZnSO_4 \cdot 7H_2O$ | 16 | g |
| $CuSO_4 \cdot 5H_2O$ | 3.2 | g |
| $MnSO_4 \cdot H_2O$ | 1.4 | g |
| $H_3BO_3$ (boric acid) | 0.8 | g |
| Bring volume to | 1 | L |

Production of MUT3325 BY Fermentation

Fermentation seed culture was prepared by inoculating 0.5 L of minimal medium in a 2-L baffled flask with 1.0 mL frozen spore suspension of the MUT3325 expression strain TRM05-3 (The minimal medium was composed of 5 g/L ammonium sulfate, 4.5 g/L potassium phosphate monobasic, 1.0 g/L magnesium sulfate heptahydrate, 14.4 g/L citric acid anhydrous, 1 g/L calcium chloride dihydrate, 25 g/L glucose and trace elements including 0.4375 g/L citric acid, 0.5 g/L ferrous sulfate heptahydrate, 0.04 g/L zinc sulfate heptahydrate, 0.008 g/L cupric sulfate pentahydrate, 0.0035 g/L manganese sulfate monohydrate and 0.002 g/L boric add. The pH was 5.5.). The culture was grown at 32° C. and 170 rpm for 48 hours before transferred to 8 L of the production medium in a 14-L fermentor. The production medium was composed of 75 g/L glucose, 4.5 g/L potassium phosphate monobasic, 0.6 g/L calcium chloride dihydrate, 1.0 g/L magnesium sulfate heptahydrate, 7.0 g/L ammonium sulfate, 0.5 g/L citric acid anhydrous, 0.5 g/L ferrous sulfate heptahydrate, 0.04 g/L zinc sulfate heptahydrate, 0.00175 g/L cupric sulfate pentahydrate, 0.0035 g/L manganese sulfate monohydrate, 0.002 g/L boric acid and 0.3 mL/L foam blast 882.

The fermentation was first run with batch growth on glucose at 34° C., 500 rpm for 24 h. At the end of 24 h, the temperature was lowered to 28° C. and agitation speed was increased to 1000 rpm. The fermentor was then fed with a mixture of glucose and sophorose (62% w/w) at specific feed rate of 0.030 g glucose-sophorose solids/g biomass/hr. At the end of run, the biomass was removed by centrifugation and the supernatant containing the mutanase was concentrated about 10-fold by ultrafiltration using 10-kD Molecular Weight Cut-Off ultrafiltration cartridge (UFP-10-E-35; GEHealthcare, Little Chalfont, Buckinghamshire, UK). The concentrated protein was stored at −80° C.

Glucan Backbones Generated Using Reaction Mixtures Comprising Combinations Glucosyltransferases and Mutanases The GTF0544/MUT3264 reaction comprised sucrose (100 g/L), GTF0544 (SEQ ID NO: 16) (10% v/v) and MUT3264 (SEQ ID NO: 21) (10% v/v) in deionized water with total volume of 200 mL was performed at 37° C. with shaking at 125 rpm. The GTF7527/MUT3325 reaction comprised sucrose (210 g/L), concentrated GTF7527 produced in the fermenter (0.3% v/v) and MUT3325 (SEQ ID NO: 23) produced in shake flask (20% v/v) in deionized water with total volume of 100 mL was performed at 37° C. with shaking at 125 rpm. The reactions were quenched by heating at 95° C. for 5 min after 24 h. The insoluble materials were removed by centrifugation at 13,000×g for 10 min and filtration through 0.2 µm RC membrane filters. The soluble product mixtures were analyzed by HPLC to determine the concentrations of sucrose, glucose, fructose, leucrose and oligosaccharides (Table 5). The soluble products were puri- The α-(1,2) branching reactions were set up with six crude backbones from the glucosyltransferases reactions and two purified backbones from the glucosyltransferases/mutanases reactions. The branching reaction was set up with 70% of the glucan backbones after heat inactivation of the enzymes. The branching enzyme, provided as 10% (v/v) of the EC0059T1 crude cell extract, was added with 80 g/L sucrose. For the four glucan backbones produced by the following 4 strains (SG1006, SG1018, SG1031, and SG1115) with all α-(1,6) linkages, sucrose was almost all consumed and about 40% α-(1,2) branching was achieved. For three backbones (SG1051 and SG1066 from GTF reactions, GTF0544/MUT3264 from GTF/mutanase reaction) contain significant α-(1,3) or α-(1,3,6) linkages, sucrose was partially consumed and about 20-30% of α-(1,2) branching was achieved. For the backbone from the GTF7527/MUT3325 (GTF/mutanase reaction) that is predominantly α-(1,3) linkages, sucrose was not consumed and no α-(1,2) branching was achieved. Table 6 summarizes the HPLC and NMR analysis of the branching reaction products. These data demonstrates that the α-(1,2) branching enzyme is active on glucans of different molecular weights comprising predominantly α-(1,6) linkages as well as mixtures of α-(1, 6) and α-(1,3) linkages. The α-(1,2) branching enzyme is

TABLE 5

The mono-, di- and oligosaccharide profile from reactions of GTF0544/MUT3264 and GTF7527/MUT3325

| GTF | Mutanase | Product Concentration (g/L) | | | | | | | | | | | Linkage Profile of Oligosaccharides (%) | | | | | |
|---|---|---|---|---|---|---|---|---|---|---|---|---|---|---|---|---|---|---|
| | | Suc | Leu | Glu | Fru | DP ≥ 8 | DP7 | DP6 | DP5 | DP4 | DP3 | DP2 | α-1,4 | α-1,3 | α-1,3,6 | α-1,2,6 | α-1,2 | α-1,6 |
| GTF0544 | MUT3264 | 2.0 | 14.8 | 2.0 | 41.7 | 9.2 | 2.3 | 3.5 | 3.3 | 8.0 | 3.6 | 3.5 | 0.0 | 32.3 | 3.4 | 0.0 | 0.0 | 64.1 |
| GTF7527 | MUT3325 | 3.3 | 53.1 | 4.7 | 80.6 | 0.0 | 0.0 | 0.2 | 11.6 | 14.8 | 12.8 | 8.5 | 0.0 | 95.9 | 0.6 | 0.0 | 0.0 | 3.4 |

Suc = sucrose;
Leu = leucrose;
Fru = fructose;
DP = degree of polymerization fied and the purified samples were analyzed by $^1$HNMR to determine the linkage of the oligosaccharides.

not active on the glucans comprising predominantly α-(1,3) linkages.

TABLE 6

Analysis of α-(1,2) branching reaction products with different glucan backbones generated from 80 g/L sucrose at 30° C.

| | HPLC | | | | NMR Linkage (%) | | | |
|---|---|---|---|---|---|---|---|---|
| Samples | Final Sucrose (g/L) | Leucrose (g/L) | Glucose (g/L) | Fructose (g/L) | α-1,2,6 | α-1,6 | α-1,3 | α-1,3,6 |
| EC0059T1-1006 | 1.8 | 21.4 | 8.2 | 88.4 | 38.3 | 61.7 | 0.0 | 0.0 |
| EC0059T1-1018 | 2 | 33.1 | 9.2 | 81.3 | 40.1 | 59.9 | 0.0 | 0.0 |
| EC0059T1-1031 | 2 | 18.4 | 6.6 | 99.3 | 39.6 | 60.4 | 0.0 | 0.0 |
| EC0059T1-1051 | 39.6 | 44.4 | 16.4 | 58.5 | 28.6 | 51.3 | 3.2 | 16.8 |
| EC0059T1-1066 | 8.6 | 44.2 | 14.6 | 69.3 | 33.5 | 52.3 | 11.3 | 2.9 |
| EC0059T1-1115 | 1.2 | 17.2 | 8.5 | 92.3 | 39.0 | 61.0 | 0.0 | 0.0 |
| EC0059T1-0544/3264 | 66.6 | 0 | 0.5 | 7 | 22.8 | 58.2 | 15.4 | 3.6 |
| EC0059T1-7527/3325 | 79.8 | 0.2 | 2.7 | 2.8 | 0.0 | 2.6 | 95.9 | 1.6 |

Example 4

Expression of Dextrin Dextranase from *Gluconobacter oxydans* in *Escherichia coli*

The following example describes expression of dextrin dextranase (DDase) from *Gluconobacter oxydans* NCIMB4943 in *E. coli* BL21 DE3. The malQ gene encoding the amylomaltase in the native *E. coli* predominantly contributed to the background activity of maltodextrin conversion. The dextrin dextranase was subsequently expressed in an *E. coli* BL21 DE3 ΔmalQ host.

Dextrin dextranase (DDase) (SEQ ID NO: 26) uses α-(1, 4) linked maltodextrins as substrates to make α-(1,6) linked dextrans by sequential transfer of a glucose unit from the non-reducing end. The DDase coding sequence (SEQ ID NO: 25) from *Gluconobacter oxydans* NCIMB4943 was amplified by PCR and cloned into the NheI and HindIII sites of pET23D vector. The sequence confirmed DDase gene expressed by the T7 promoter on plasmid pDCQ863 was transformed into *E. coli* BL21 DE3 host. The resulting strain together with the BL21 DE3 host control were grown at 37° C. with shaking at 220 rpm to $OD_{600}$ of ~0.5 and IPTG was added to a final concentration of 0.5 mM for induction. The cultures were grown for additional 2-3 hours before harvest by centrifugation at 4000×g. The cell pellets from 1 L of culture were suspended in 30 mL 20 mM KPi buffer, pH 6.8. Cells were disrupted by French Cell Press (2 passages @ 15,000 psi (~103.4 MPa)); Cell debris was removed by centrifugation (Sorvall SS34 rotor, @13,000 rpm) for 40 min. The supernatant (10%) was incubated with maltotetraose (DP4) substrate (Sigma) at 16 g/L final concentration in 25 mM sodium acetate buffer pH4.8 at 37° C. overnight. The oligosaccharides profile was analyzed on HPLC. The maltotetraose (DP4) substrate was converted in the BL21 DE3 host without the expression plasmid, suggesting a background activity in the host to utilize DP4.

To check which enzyme predominantly contributed to the background activity, a set of strains from "Keio collection" (Baba et al., (2006) *Mol. Syst. Biol.*, article number 2006.0008; pages 1-11) with a single gene deletion was tested (Table 7) in the maltotetraose assay as described above. *Escherichia coli* K-12 strain BW25113 was the parental strain for the Keio collection. JW3543 contains a deletion of the malS (SEQ ID NO: 28) encoding a periplasmic α-amylase. JW1912 contains a deletion of amyA (SEQ ID NO: 31) encoding a cytoplasmic α-amylase. JW3379 contains a deletion of malQ (SEQ ID NO: 27) encoding an amylomaltase. JW5689 contains a deletion of malP (SEQ ID NO: 29) encoding a maltodextrin phosphorylase. JW0393 contains a deletion of malZ (SEQ ID NO: 30) encoding a maltodextrin glucosidase. The maltotetraose control (G4 control) does not contain any cell extract, When BW25113 cell extract was added, most maltotetraose was converted, indicating the background activity in BW25113. For the five Keio deletion strains tested, four of them still showed the background activity as the BW25113 parental strain. Only JW3379 with malQ deletion showed that most of the background activity was abolished and maltotetraose was retained as the G4 control. This experiment suggested that malQ predominantly contributed to the background activity. The malQ:kanR deletion in the JW3379 was transferred to the BL21 DE3 strain by standard P1 transduction to make the BL21 DE3 ΔmalQ expression host.

The pDCQ863 expressing the DDase and the pET23D vector control was transformed into the BL21 DE3 ΔmalQ expression host resulting EC0063 expression host. The cell extracts were prepared and assayed with maltotetraose substrate ad describe above. The result in Table 8 showed that pET23D in BL21 DE3 had background activity for maltotetraose conversion, but no background activity in the BL21 DE3 ΔmalQ host. When pDCQ863 encoding the DDase was expressed in the BL21 DE3 ΔmalQ host, maltotetraose was converted due to activity of the DDase. The EC0063 expressing DDase was used as the source of DDase enzyme for glucan production.

TABLE 7

Test background activity in *E. coli* hosts with single gene knockout from Keio collection

| Sample | Gene deleted | DP8 & up est. (g/L) | DP7 (g/L) | DP6 (g/L) | DP5 (g/L) | DP4 (g/L) | DP3 (g/L) | DP2 (g/L) | Glucose (g/L) |
|---|---|---|---|---|---|---|---|---|---|
| BW25113 | none | 4.8 | 1.1 | 1.5 | 1.8 | 2.2 | 1.9 | 1.6 | 1.1 |
| JW3543 | ΔmalS | 4.8 | 1.1 | 1.4 | 1.8 | 2.2 | 1.9 | 1.6 | 1.2 |
| JW3379 | ΔmalQ | 0.2 | 0.0 | 0.1 | 0.3 | 16.2 | 0.7 | 0.3 | 0.0 |
| JW1912 | ΔamyA | 5.6 | 1.3 | 1.3 | 1.8 | 1.9 | 1.6 | 1.4 | 0.8 |
| JW0393 | ΔmalZ | 4.4 | 1.1 | 1.4 | 1.9 | 2.2 | 2.0 | 1.8 | 0.0 |
| JW5689 | ΔmalP | 4.9 | 1.2 | 1.5 | 1.8 | 2.6 | 1.7 | 1.4 | 1.0 |
| G4 cntl |  | 0.2 | 0.0 | 0.0 | 0.0 | 17.0 | 0.9 | 0.0 | 0.0 |

TABLE 8

Expression of DDase in the BL21 DE3 ΔmalQ host

| Sample | Host | Gene expressed | DP8 & up est. (g/L) | DP7 (g/L) | DP6 (g/L) | DP5 (g/L) | DP4 (g/L) | DP3 (g/L) | DP2 (g/L) | Glucose (g/L) |
|---|---|---|---|---|---|---|---|---|---|---|
| EC0063-ΔmalQ | BL21-DE3ΔmalQ | DDase | 0.2 | 0.2 | 0.3 | 0.7 | 1.1 | 2.5 | 5.5 | 0.4 |
| BL21-DE3ΔmalQ pET23D | BL21-DE3ΔmalQ | None | 0.2 | 0.0 | 0.0 | 0.0 | 16.6 | 0.6 | 0.3 | 0.0 |

TABLE 8-continued

Expression of DDase in the BL21 DE3 ΔmalQ host

| Sample | Host | Gene expressed | DP8 & up est. (g/L) | DP7 (g/L) | DP6 (g/L) | DP5 (g/L) | DP4 (g/L) | DP3 (g/L) | DP2 (g/L) | Glucose (g/L) |
|---|---|---|---|---|---|---|---|---|---|---|
| BL21-DE3 pET23D | BL21-DE3 | None | 3.3 | 1.1 | 1.3 | 2.1 | 3.6 | 2.0 | 1.6 | 1.5 |
| G4 control | | | 0.2 | 0.00 | 0.00 | 0.00 | 17.3 | 0.3 | 0.00 | 0.00 |

Example 5

Addition of α-(1,2) Branching to Different Glucan Backbones Generated from Maltodextrin The following example describes the evaluation of the α-(1,2) branching activity of EC0059T1 (SEQ ID NO: 6) on glucan backbones generated from maltodextrins (MD). The results demonstrate that the α-(1,2) branching enzyme is also active on glucans with mixtures of α-(1,6) and α-(1,4) linkages generated using a DDase reaction from maltodextrin substrates. The branching reaction could be performed sequentially after the glucan backbone reaction or concurrently with the glucan backbone reaction.

The EC0063 strain expressing the active DDase (SEQ ID ON: 26) was used to convert maltodextrins to nondigestible glucan fibers. Two types of maltodextrins with DE13-17 and DE 4-7 were used as substrates. The 10% (v/v) of EC0063 extract was incubated with 100 g/L MD substrate in 25 mM sodium acetate buffer pH4.8 at 37° C. overnight. The linkage profile of the products was analyzed by NMR. The digestibility of the products was analyzed by Megazyme digestibility assay. Both types of substrates behaved similarly that there are about 95% α-(1,4) linkages and 5% α-(1,6) linkages in the substrates. The non-digestibility of the maltodextrin substrates was about 5-10% (i.e., a digestibility of approximately 90-95%). After the maltodextrin substrates were reacted with DDase, the reaction products of the DDase had about 65-75% α-(1,6) linkages with remaining as α-(1,4) linkages. The nondigestibility of the products also increased to about 65-75%.

For the branching of the DDase product, the branching enzyme extract could be added to the DDase reaction sequentially or concurrently. In the sequential reaction, the 10% EC0063 extract containing DDase was reacted with 100 g/L maltodextrin substrate first as described above. The reaction was heat killed for 5 min at 95° C. Eighty percent of the DDase reaction product was used to set up the branching reaction by adding 40 g/L sucrose and 10% of the EC0059T1 extract containing the GtfJ18T1 branching enzyme. This branching reaction was incubated at 30° C. for 24-48 hours and then heat killed for analysis by HPLC, NMR and Megazyme digestibility. In the concurrent reaction, 80 g/L maltodextrin substrate (DE13-17) was reacted with 10% of EC0063 extract containing DDase and 10% of EC0059T1 extract containing GtfJ18T1 concomitantly in 25 mM sodium acetate buffer pH4.8 with 40 g/L sucrose. The reaction was incubated at 30° C. for 24-48 hours and reaction products analyzed the same way as the sequential reaction products. Data in table 9 showed that sequential reaction and concurrent reaction produced similar products. Both reactions generated glucans with about 15% α-(1,2) linkages. The nondigestibility of the products also increased with the introduction of the branching.

TABLE 9

Analysis of sequential and concurrent reaction products of DDase and branching enzyme GtfJ18T1 using maltodextrin DE13-17 as substrate

| Rxn | Enzyme 1 | Enzyme 2 | % Not digestible | 1,4 | 1,2,6 | 1,3 | 1,6 |
|---|---|---|---|---|---|---|---|
| Backbone only | DDase | none | 75.3% | 24.8 | 0.0 | 0.0 | 75.2 |
| Sequential | DDase | GtfJ18T1 | 81.3% | 22.6 | 15.8 | 0.0 | 61.6 |
| Concurrent | DDase | GtfJ18T1 | 83.1% | 24.8 | 13.5 | 0.0 | 61.6 |
| MD control | none | none | 11.1% | 95.2 | 0.0 | 0.0 | 4.8 |

Example 6

Purification and Isolation of Soluble Fiber Produced by α-(1,2) Branching Reactions The α-(1,2) branching reactions were set up with six crude backbones from the glucosyltransferases reactions and one purified backbone from a glucosyltransferases/mutanase reaction as described in Example 3. The 400-mL reactions started with 200 g/L sucrose and 5% (v/v) enzyme solution (0.22 micron sterile filtered) in 10 mM sodium citrate buffer (pH 5.0) and 0.1 mM calcium chloride at 37° C. with shaking. The reactions were monitored by HPLC for 1-3 days until sucrose was all consumed. At completion of sucrose conversion, the enzymes were inactivated by heating the reaction mixture to 95° C. for 30 minutes, followed by cooling to room temperature. The resulting mixture was centrifuged to remove any precipitates, and the glucan backbone-containing supernatant was employed in the branching reaction.

The 600-mL branching reactions were set up starting with 420 mL (70% v/v) of the glucan backbone-containing supernatant prepared as described above. The branching enzyme, provided as 5% (v/v) of the EC0059T1 crude cell extract (30 mL, (0.22 micron sterile filtered)), was added with 120 mL of 40 wt % sucrose in water (final concentration of 80 g/L sucrose) and 30 mL of deionized water. The reactions were run at 30° C. and between pH 5.0-6.0 with shaking at 180-200 rpm, and sucrose conversion was monitored by HPLC. At completion of sucrose conversion, the enzyme was inactivated by heating the reaction mixture to 95° C. for 30 minutes, followed by cooling to room temperature. The resulting mixture was centrifuged to remove any precipitates, then the supernatant was purified by SEC using BioGel P2 resin (BioRad). The SEC fractions that contained oligosaccharides DP3 were combined and concentrated by rotary evaporation for analysis by HPLC (Table 10).

TABLE 10

HPLC analysis of soluble oligosaccharide fiber produced by α-(1,2) branching reactions.

| | DP8+ g/L | DP7 g/L | DP6 g/L | DP5 g/L | DP4 g/L | DP3 g/L | DP2 g/L | Sucrose g/L | Leucrose g/L | Glucose g/L | Fructose g/L |
|---|---|---|---|---|---|---|---|---|---|---|---|
| EC59T-1006 | 167 | 0.0 | 0.0 | 0.0 | 0.0 | 0.0 | 0.0 | 0.0 | 0.0 | 0.0 | 0.0 |
| EC59T-1018 | 196 | 1.2 | 0.0 | 0.6 | 0.5 | 0.0 | 0.0 | 0.0 | 0.0 | 0.0 | 0.0 |
| EC59T-1031 | 167 | 0.0 | 0.0 | 0.0 | 0.5 | 0.0 | 0.0 | 3.5 | 0.4 | 0.1 | 1.4 |
| EC59T-1051 | 196 | 1.2 | 0.0 | 0.6 | 0.5 | 0.0 | 0.0 | 1.7 | 1.0 | 0.0 | 0.7 |
| EC59T-1066 | 120 | 23.0 | 19.5 | 15.7 | 6.3 | 1.8 | 0.0 | 0.7 | 0.1 | 0.1 | 0.1 |
| EC59T-1115 | 183 | 0.0 | 0.0 | 0.0 | 0.0 | 0.0 | 0.0 | 1.6 | 0.2 | 0.0 | 1.3 |
| EC59T-0544/3486 | 119 | 18.0 | 12.7 | 11.9 | 14.8 | 6.1 | 2.9 | 1.4 | 0.4 | 1.9 | 1.8 |

Example 7

Anomeric Linkage Analysis of Soluble Fiber Produced by by α-(1,2) Branching Reactions Solutions of soluble fibers purified by SEC as described in Example 6 were dried to a constant weight by lyophilization, and the resulting solids analyzed by $^1$H NMR spectroscopy and by GC/MS as described in the General Methods section (above). The anomeric linkages for each of these soluble oligosaccharide fiber mixtures are reported in Tables 11 and 12.

TABLE 11

Anomeric linkage analysis of soluble oligosaccharides by $^1$H NMR spectroscopy.

| GTF | % α-(1,3) | % α-(1,2) | % α-(1,3,6) | % α-(1,2,6) | % α-(1,6) |
|---|---|---|---|---|---|
| EC0059T1-1006 | 0.00 | 6.10 | 0.80 | 6.10 | 87.00 |
| EC0059T1-1018 | 0.00 | 6.79 | 0.00 | 6.79 | 86.42 |
| EC0059T1-1031 | 0.00 | 9.68 | 0.00 | 9.68 | 80.65 |
| EC0059T1-1051 | 0.00 | 3.92 | 18.51 | 3.92 | 73.65 |
| EC0059T1-1066 | 8.87 | 6.52 | 1.06 | 6.52 | 77.02 |
| EC0059T1-1115 | 0.00 | 2.63 | 0.00 | 2.63 | 94.74 |
| EC0059T1-0544/3264 | 15.05 | 11.32 | 3.31 | 11.32 | 59.01 |

TABLE 12

Anomeric linkage analysis of soluble oligosaccharides by GC/MS.

| GTF | % α-(1,4) | % α-(1,3) | % α-(1,3,6) | % 2,1 Fruc | % α-(1,2) | % α-(1,6) | % α-(1,2,6) | % α-(1,4,6) |
|---|---|---|---|---|---|---|---|---|
| E00059T1-1006 | 1.4 | 1.4 | 0.6 | 0.0 | 0.7 | 89.3 | 6.5 | 0.0 |
| E00059T1-1018 | 1.6 | 0.0 | 0.0 | 0.0 | 0.7 | 90.6 | 7.1 | 0.0 |
| E00059T1-1031 | 0.5 | 0.0 | 0.0 | 0.0 | 0.7 | 88.0 | 10.7 | 0.0 |
| E00059T1-1051 | 0.0 | 0.5 | 16.9 | 0.0 | 0.0 | 78.6 | 4.0 | 0.0 |
| E00059T1-1066 | 0.3 | 13.7 | 0.4 | 1.4 | 1.6 | 78.3 | 4.2 | 0.0 |
| E00059T1-1115 | 0.0 | 0.0 | 0.0 | 0.0 | 0.0 | 98.0 | 2.0 | 0.0 |
| E00059T1-0544/3264 | 1.6 | 28.7 | 1.9 | 1.0 | 3.1 | 56.8 | 6.9 | 0 |

Example 8

Viscosity of Soluble Fiber Produced by α-(1,2) Branching Reactions

Solutions of soluble fibers purified by SEC as described in Example 6 were dried to a constant weight by lyophilization, and the resulting solids were used to prepare a 12 wt % solution of soluble fiber in distilled, deionized water. The viscosity of the soluble fiber solutions (reported in centipoise (cP), where 1 cP=1 millipascal-s (mPa-s)) (Table 13) was measured at 20° C. as described in the General Methods section.

TABLE 13

Viscosity of 12% (w/w) soluble oligosaccharide fiber solutions measured at 20° C.

| GTF | viscosity (cP) |
|---|---|
| EC0059T1-1006 | 2.9 |
| EC0059T1-1018 | 2.1 |
| EC0059T1-1031 | 28.3 |
| EC0059T1-1051 | 6.1 |
| EC0059T1-1066 | 1.8 |
| EC0059T1-1115 | 4.7 |
| EC0059T1-0544/3264 | 4.7 |

Example 9

Digestibility of Soluble Fiber Produced by by α-(1,2) Branching Reactions

Solutions of soluble fibers purified by SEC as described in Example 6 were dried to a constant weight by lyophilization. The digestibility test protocol was adapted from the Megazyme Integrated Total Dietary Fiber Assay (AOAC method 2009.01, Ireland). The final enzyme concentrations were kept the same as the AOAC method: 50 Unit/mL of pancreatic α-amylase (PAA), 3.4 Units/mL for amyloglucosidase (AMG). The substrate concentration in each reaction was 25 mg/mL as recommended by the AOAC method. The total volume for each reaction was 1 mL. Every sample was analyzed in duplicate with and without the treatment of the two digestive enzymes. The amount of released glucose was quantified by HPLC with the Aminex HPX-87C Columns (BioRad) as described in the General Methods. Maltodextrin (DE4-7, Sigma) was used as the positive control for the enzymes (Table 14).

TABLE 14

Digestibility of soluble oligosaccharide fiber.

| GTF | Digestibility (%) |
|---|---|
| EC0059T1-1006 | 2 |
| EC0059T1-1018 | 3 |
| EC0059T1-1031 | 0 |
| EC0059T1-1051 | 5 |
| EC0059T1-1066 | 7 |
| EC0059T1-1115 | 0 |
| EC0059T1-0544/3264 | 0 |

Example 10

Molecular Weight Of Soluble Fiber Produced by by α-(1,2) Branching Reactions

Solutions of soluble fibers purified by SEC as described in Example 6 were dried to a constant weight by lyophilization, and the resulting solids were analyzed by SEC chromatography for number average molecular weight ($M_n$), weight average molecular weight ($M_w$), peak molecular weight ($M_p$), z-average molecular weight ($M_z$), and polydispersity index (PDI=$M_w/M_n$) as described in the General Methods section (Table 15)

TABLE 15

Characterization of soluble oligosaccharide fiber by SEC.

| GTF | $M_n$ (Daltons) | $M_w$ (Daltons) | $M_p$ (Daltons) | $M_z$ (Daltons) | PDI |
|---|---|---|---|---|---|
| EC0059T1-1006 | 9715 | 12076 | 15000 | 13963 | 1.243 |
| EC0059T1-1018 | 4595 | 4874 | 5200 | 5116 | 1.061 |
| EC0059T1-1031 | 88298 | 140829 | 90900 | 307162 | 1.595 |
| EC0059T1-1051 | 7486 | 33153 | 16800 | 4393313 | 4.428 |
| EC0059T1-1066 | 1914 | 1952 | 2100 | 1988 | 1.02 |
| EC0059T1-1115 | 15228 | 15759 | 16700 | 16218 | 1.035 |
| EC0059T1-0544/3264 | 29614 | 269657 | 19300 | 3977773 | 25.385 |

Example 11

In Vitro Gas Production Using Soluble Oligosaccharide/Polysaccharide Fiber as Carbon Source Solutions of chromatographically-purified soluble oligosaccharide/polysaccharide fibers were dried to a constant weight by lyophilization. The individual soluble oligosaccharide/polysaccharide soluble fiber samples were subsequently evaluated as carbon source for in vitro gas production using the method described in the General Methods. PROMITOR® 85 (soluble corn fiber, Tate & Lyle), NUTRIOSE® FMO6 (soluble corn fiber or dextrin, Roquette), FIBERSOL-2® 600F (digestion-resistant maltodextrin, Archer Daniels Midland Company & Matsutani Chemical), ORAFTI® GR (inulin from Beneo, Mannheim, Germany), LITESSE® Ultra™ (polydextrose, Danisco), GOS (galactooligosaccharide, Clasado Inc., Reading, UK), ORAFTI® P95 (oligofructose (fructo-oligosaccharide, FOS, Beneo), LACTITOL MC (4-O-β-D-Galactopyranosyl-D-glucitol monohydrate, Danisco) and glucose were included as control carbon sources. Table 16 lists the In vitro gas production by intestinal microbiota at 3 h and 24 h.

TABLE 16

In vitro gas production by intestinal microbiota.

| Sample | mL gas formation in 3 h | mL gas formation in 24 h |
|---|---|---|
| PROMITOR® 85 | 2.6 | 8.5 |
| NUTRIOSE® FM06 | 3.0 | 9.0 |
| FIBERSOL-2® 600F | 2.8 | 8.8 |
| ORAFTI® GR | 3.0 | 7.3 |
| LITESSE® ULTRA™ | 2.3 | 5.8 |
| GOS | 2.6 | 5.2 |
| ORAFTI® P95 | 2.6 | 7.5 |
| LACTITOL® MC | 2.0 | 4.8 |
| Glucose | 2.4 | 5.2 |
| EC0059T1-1006 | 3.3 | 10.0 |
| EC0059T1-1018 | 3.8 | 14.8 |
| EC0059T1-1031 | 3.0 | 5.0 |
| EC0059T1-1051 | 3.5 | 8.5 |
| EC0059T1-1066 | 4.0 | 9.5 |
| EC0059T1-1115 | 3.0 | 6.5 |
| EC0059T1-0544/3264 | 3.0 | 8.3 |

Example 12

Colonic Fermentation Modeling and Measurement of Fatty Acids

Colonic fermentation was modeled using a semi-continuous colon simulator as described by Mäkivuokko et al. (*Nutri. Cancer* (2005) 52(1):94-104); in short; a colon simulator consists of four glass vessels which contain a simulated ileal fluid as described by Macfarlane et al. (*Microb. Ecol.* (1998) 35(2):180-187). The simulator is inoculated with a fresh human faecal microbiota and fed every third hour with new ileal liquid and part of the contents is transferred from one vessel to the next. The ileal fluid contains one of the described test components at a concentration of 1%. The simulation lasts for 48 h after which the content of the four vessels is harvested for further analysis. The further analysis involves the determination of microbial metabolites such as short chain fatty acids (SCFA); also referred to as volatile fatty acids (VFA) and branched chain fatty acids (BCFA). Analysis was performed as described by Holben et al. (*Microb. Ecol.* (2002) 44:175-185); in short; simulator content was centrifuged and the supernatant was used for SCFA and BCFA analysis. Pivalic acid (internal standard) and water were mixed with the supernatant and centrifuged. After centrifugation, oxalic acid solution was added to the supernatant and then the mixture was incubated at 4° C., and then centrifuged again. The resulting supernatant was analyzed by gas chromatography using a flame ionization detector and helium as the carrier gas. Comparative data generated from samples of LITESSE® ULTRA™ (polydextrose, Danisco), ORAFTI® P95 (oligofructose; fructo-oligosaccharide, "FOS", Beneo), lactitol (Lactitol MC (4-O-β-D-galactopyranosyl-D-glucitol monohydrate, Danisco), and a negative control is also provided. The concentration of acetic, propionic, butyric, isobutyric, valeric, isovaleric, 2-methylbutyric, and lactic acid was determined (Table 17).

TABLE 17

Simulator metabolism and measurement of fatty acid production.

| Sample | Acetic (mM) | Propionic (mM) | Butyric (mM) | Lactic (mM) | Valeric (mM) | Short Chain Fatty Acids (SCFA) (mM) | Branched Chain Fatty Acids (BCFA) (mM) |
|---|---|---|---|---|---|---|---|
| EC0059T1-1115 | 199 | 95 | 88 | 0 | 4 | 386 | 5.1 |
| Control | 83 | 31 | 40 | 3 | 6 | 163 | 7.2 |
| LITESSE ® polydextrose | 256 | 76 | 84 | 1 | 6 | 423 | 5.3 |
| FOS | 91 | 9 | 8 | 14 | — | 152 | 2.1 |
| Lactitol | 318 | 42 | 94 | 52 | — | 506 | 7.5 |

Example 13

Preparation of a Yogurt—Drinkable Smoothie

The following example describes the preparation of a yogurt—drinkable smoothie with the present fibers.

TABLE 18

| Ingredients | wt % |
|---|---|
| Distilled Water | 49.00 |
| Supra XT40 Soy Protein Isolate | 6.50 |
| Fructose | 1.00 |
| Grindsted ASD525, Danisco | 0.30 |
| Apple Juice Concentrate (70 Brix) | 14.79 |
| Strawberry Puree, Single Strength | 4.00 |
| Banana Puree, Single Strength | 6.00 |
| Plain Lowfat Yogurt - Greek Style, Cabot | 9.00 |
| 1% Red 40 Soln | 0.17 |
| Strawberry Flavor (DD-148-459-6) | 0.65 |
| Banana Flavor (#29513) | 0.20 |
| 75/25 Malic/Citric Blend | 0.40 |
| Present Soluble Fiber Sample | 8.00 |
| Total | 100.00 |

| Step No. | Procedure |
|---|---|
| | Pectin Solution Formation |
| 1 | Heat 50% of the formula water to 160° F. (~71.1° C.). |
| 2 | Disperse the pectin with high shear; mix for 10 minutes. |
| 3 | Add the juice concentrates and yogurt; mix for 5-10 minutes until the yogurt is dispersed. |
| | Protein Slurry |
| 1 | Into 50% of the batch water at 140° F. (60° C.), add the Supro XT40 and mix well. |
| 2 | Heat to 170° F. (~76.7° C.) and hold for 15 minutes. |
| 3 | Add the pectin/juice/yogurt slurry to the protein solution; mix for 5 minutes. |
| 4 | Add the fructose, fiber, flavors and colors; mix for 3 minutes. |
| 5 | Adjust the pH using phosphoric acid to the desired range (pH range 4.0-4.1). |
| 6 | Ultra High Temperature (UHT) process at 224° F. (~106.7° C.) for 7 seconds with UHT homogenization after heating at 2500/500 psig (17.24/3.45 MPa) using the indirect steam (IDS) unit. |
| 7 | Collect bottles and cool in ice bath. |
| 8 | Store product in refrigerated conditions. |

Example 14

Preparation of a Fiber Water Formulation

The following example describes the preparation of a fiber water with the present fibers.

TABLE 19

| Ingredient | wt % |
|---|---|
| Water, deionized | 86.41 |
| Pistachio Green #06509 | 0.00 |
| Present Soluble Fiber Sample | 8.00 |
| Sucrose | 5.28 |
| Citric Acid | 0.08 |
| Flavor (M748699M) | 0.20 |
| Vitamin C, ascorbic acid | 0.02 |
| TOTAL | 100.00 |

| Step No. | Procedure |
|---|---|
| 1 | Add dry ingredients and mix for 15 minutes. |
| 2 | Add remaining dry ingredients; mix for 3 minutes |
| 3 | Adjust pH to 3.0 +/− 0.05 using citric acid as shown in formulation. |
| 4 | Ultra High Temperature (UHT) processing at 224° F. (~106.7° C.) for 7 seconds with homogenization at 2500/500 psig (17.24/3.45 MPa). |
| 5 | Collect bottles and cool in ice bath. |
| 6 | Store product in refrigerated conditions. |

Example 15

Preparation of a Spoonable Yogurt Formulation

The following example describes the preparation of a spoonable yogurt with the present fibers.

TABLE 20

| Ingredient | wt % |
|---|---|
| Skim Milk | 84.00 |
| Sugar | 5.00 |
| Yogurt (6051) Cultures (add to pH break point) | 3.00 |
| Present Soluble Fiber | 8.00 |
| TOTAL | 100.00 |

| Step No. | Procedure |
|---|---|
| 1 | Add dry ingredients to base milk liquid; mix for 5 min. |
| 2 | Pasteurize at 195° F. (~90.6° C.) for 30 seconds, homogenize at 2500 psig (~17.24 MPa), and cool to 105-110° F. (~40.6-43.3° C.). |
| 3 | Inoculate with culture; mix gently and add to water batch or hot box at 108° F. (~42.2° C.) until pH reaches 4.5-4.6. |
| | Fruit Prep Procedure |
| 1 | Add water to batch tank, heat to 140° F. (~60° C.). |
| 2 | Pre-blend carbohydrates and stabilizers. Add to batch tank and mix well. |
| 3 | Add Acid to reduce the pH to the desired range (target pH 3.5-4.0). |
| 4 | Add Flavor. |
| 5 | Cool and refrigerate. |

Example 16

Preparation of a Model Snack Bar Formulation

The following example describes the preparation of a model snack bar with the present fibers.

TABLE 21

| Ingredients | wt % |
| --- | --- |
| Corn Syrup 63 DE | 15.30 |
| Present Fiber solution (70 Brix) | 16.60 |
| Sunflower Oil | 1.00 |
| Coconut Oil | 1.00 |
| Vanilla Flavor | 0.40 |
| Chocolate Chips | 7.55 |
| SUPRO ® Nugget 309 | 22.10 |
| Rolled Oats | 18.00 |
| Arabic Gum | 2.55 |
| Alkalized Cocoa Powder | 1.00 |
| Milk Chocolate Coating Compound | 14.50 |
| TOTAL | 100.00 |

| Step No. | Procedure |
| --- | --- |
| 1 | Combine corn syrup with liquid fiber solution. Warm syrup in microwave for 10 seconds. |
| 2 | Combine syrup with oils and liquid flavor in mixing bowl. Mix for 1 minute at speed 2. |
| 3 | Add all dry ingredient in bowl and mix for 45 seconds at speed 1. |
| 4 | Scrape and mix for another 30 seconds or till dough is mixed. |
| 5 | Melt chocolate coating. |
| 6 | Fully coat the bar with chocolate coating. |

Example 17

Preparation of a High Fiber Wafer

The following example describes the preparation of a high fiber wafer with the present fibers.

TABLE 22

| Ingredients | wt % |
| --- | --- |
| Flour, white plain | 38.17 |
| Present fiber | 2.67 |
| Oil, vegetable | 0.84 |
| GRINSTED ® CITREM 2-in-1[1] citric acid ester made from sunflower or palm oil (emulsifier) | 0.61 |
| Salt | 0.27 |
| Sodium bicarbonate | 0.11 |
| Water | 57.33 |

[1]Danisco.

| Step No. | Procedure |
| --- | --- |
| 1. | High shear the water, oil and CITREM for 20 seconds. |
| 2. | Add dry ingredients slowly, high shear for 2-4 minutes. |
| 3. | Rest batter for 60 minutes. |
| 4. | Deposit batter onto hot plate set at 200° C. top and bottom, bake for 1 minute 30 seconds |
| 5. | Allow cooling pack as soon as possible. |

Example 18

Preparation of a Soft Chocolate Chip Cookie

The following example describes the preparation of a soft chocolate chip cookie with the present fibers.

TABLE 23

| Ingredients | wt % |
| --- | --- |
| Stage 1 | |
| Lactitol, C | 16.00 |
| Cake margarine | 17.70 |
| Salt | 0.30 |
| Baking powder | 0.80 |
| Eggs, dried whole | 0.80 |
| Bicarbonate of soda | 0.20 |
| Vanilla flavor | 0.26 |
| Caramel flavor | 0.03 |
| Sucralose powder | 0.01 |
| Stage 2 | |
| Present Fiber Solution (70 brix) | 9.50 |
| water | 4.30 |
| Stage 3 | |
| Flour, pastry | 21.30 |
| Flour, high ratio cake | 13.70 |
| Stage Four | |
| Chocolate chips, 100% lactitol, sugar free | 15.10 |

| Step No. | Procedure |
| --- | --- |
| 1. | Cream together stage one, fast speed for 1 minute. |
| 2. | Blend stage two to above, slow speed for 2 minutes. |
| 3. | Add stage three, slow speed for 20 seconds. |
| 4. | Scrape down bowl; add stage four, slow speed for 20 seconds. |
| 5. | Divide into 30 g pieces, flatten, and place onto silicone lined baking trays. |
| 6. | Bake at 190° C. for 10 minutes approximately. |

Example 19

Preparation of a Reduced Fat Short-Crust Pastry

The following example describes the preparation of a reduced fat short-crust pastry with the present fibers.

TABLE 24

| Ingredients | wt % |
| --- | --- |
| Flour, plain white | 56.6 |
| Water | 15.1 |
| Margarine | 11.0 |
| Shortening | 11.0 |
| Present fiber | 6.0 |
| Salt | 0.3 |

| Step No. | Procedure |
|---|---|
| 1. | Dry blend the flour, salt and present glucan fiber (dry) |
| 2. | Gently rub in the fat until the mixture resembles fine breadcrumbs. |
| 3. | Add enough water to make a smooth dough. |

Example 20

Preparation of a Low Sugar Cereal Cluster

The following example describes the preparation of a low sugar cereal cluster with one of the present fibers.

TABLE 25

| Ingredients | wt % |
|---|---|
| Syrup Binder | 30.0 |
| Lactitol, MC 50% | |
| Present Fiber Solution (70 brix) 25% | |
| Water 25% | |
| Cereal Mix | 60.0 |
| Rolled Oats 70% | |
| Flaked Oats 10% | |
| Crisp Rice 10% | |
| Rolled Oats 10% | |
| Vegetable oil | 10.0 |

| Step No. | Procedure |
|---|---|
| 1. | Chop the fines. |
| 2. | Weight the cereal mix and add fines. |
| 3. | Add vegetable oil on the cereals and mix well. |
| 4. | Prepare the syrup by dissolving the ingredients. |
| 5. | Allow the syrup to cool down. |
| 6. | Add the desired amount of syrup to the cereal mix. |
| 7. | Blend well to ensure even coating of the cereals. |
| 8. | Spread onto a tray. |
| 9. | Place in a dryer/oven and allow to dry out. |
| 10. | Leave to cool down completely before breaking into clusters. |

Example 21

Preparation of a Pectin Jelly

The following example describes the preparation of a pectin jelly with the present fibers.

TABLE 26

| Ingredients | wt % |
|---|---|
| Component A | |
| Xylitol | 4.4 |
| Pectin | 1.3 |
| Component B | |
| Water | 13.75 |
| Sodium citrate | 0.3 |
| Citric Acid, anhydrous | 0.3 |
| Component C | |
| Present Fiber Solution (70 brix) | 58.1 |
| Xylitol | 21.5 |

TABLE 26-continued

| Ingredients | wt % |
|---|---|
| Component D | |
| Citric acid | 0.35 |
| Flavor, Color | q.s. |

| Step No. | Procedure |
|---|---|
| 1. | Dry blend the pectin with the xylitol (Component A). |
| 2. | Heat Component B until solution starts to boil. |
| 3. | Add Component A gradually, and then boil until completely dissolved. |
| 4. | Add Component C gradually to avoid excessive cooling of the batch. |
| 5. | Boil to 113° C. |
| 6. | Allow to cool to <100° C. and then add colour, flavor and acid (Component D). Deposit immediately into starch molds. |
| 7. | Leave until firm, then de-starch. |

Example 22

Preparation of a Chewy Candy

The following example describes the preparation of a chewy candy with the present fibers.

TABLE 27

| Ingredients | wt % |
|---|---|
| Present glucan fiber | 35 |
| Xylitol | 35 |
| Water | 10 |
| Vegetable fat | 4.0 |
| Glycerol Monostearate (GMS) | 0.5 |
| Lecithin | 0.5 |
| Gelatin 180 bloom (40% solution) | 4.0 |
| Xylitol, CM50 | 10.0 |
| Flavor, color & acid | q.s. |

| Step No. | Procedure |
|---|---|
| 1. | Mix the present glucan fiber, xylitol, water, fat, GMS and lecithin together and then cook gently to 158° C.. |
| 2. | Cool the mass to below 90° C. and then add the gelatin solution, flavor, color and acid. |
| 3. | Cool further and then add the xylitol CM. Pull the mass immediately for 5 minutes. |
| 4. | Allow the mass to cool again before processing (cut and wrap or drop rolling). |

Example 23

Preparation of a Coffee—Cherry Ice Cream

The following example describes the preparation of a coffee-cherry ice cream with the present fibers.

TABLE 28

| Ingredients | wt % |
|---|---|
| Fructose, C | 8.00 |
| Present glucan fiber | 10.00 |

TABLE 28-continued

| Ingredients | wt % |
|---|---|
| Skimmed milk powder | 9.40 |
| Anhydrous Milk Fat (AMF) | 4.00 |
| CREMODAN ® SE 709 Emulsifier & Stabilizer System[1] | 0.65 |
| Cherry Flavoring U35814[1] | 0.15 |
| Instant coffee | 0.50 |
| Tri-sodium citrate | 0.20 |
| Water | 67.10 |

[1]Danisco.

| Step No. | Procedure |
|---|---|
| 1. | Add the dry ingredients to the water, while agitating vigorously. |
| 2. | Melt the fat. |
| 3. | Add the fat to the mix at 40° C. |
| 4. | Homogenize at 200 bar/70-75° C. |
| 5. | Pasteurize at 80-85° C./20-40 seconds. |
| 6. | Cool to ageing temperature (5° C.). |
| 7. | Age for minimum 4 hours. |
| 8. | Add flavor to the mix. |
| 9. | Freeze in continuous freezer to desired overrun (100% is recommended). |
| 10. | Harden and storage at −25° C. |

SEQUENCE LISTING (71 sequences)

SEQ ID NO: 1 - protein, 2771 aa, Leuconostoc mesenteroides
MTAGIFSAVIFGVSTTNVSADSTNNTGVTVSQATDKVADTTATTDKVADTTATTDKVADTAATTDKVADTTATTDKVADTAATTDKVADTTATTDKVADTAAATDKAADTAATTDKVADTAAATDKVADTVAATDKVADTTATTDKAADTAATTDKVTDTTAATDKAADTTATTDKVADTTATTSEKSKSIKQIDGKTYFIGNDGQPKKNFTAIVDGQVLYFDKDTGALTSNSSQYTDGLANIGNEHNAAYSLSSDSFTQVDGYLTANSWYRPKDILKNGTTWTAATANDFRPLLMSWWPDKDTQVSYLKYMQSAGLLSDDVALSNNDSMNSLTDTAMTVQKKIEEKIGLLGSTDWLKADMNQMVDSQSNWNISSESKGTDHLQGGALLYVNSDLTPNANSDYRLLNRTPTNQKGQITTNGNQGGYEMLLANDVDNSNPIVQAEQLNWLYYMMNIGSIAQNDPTANFDGYRVDAVDNVNADLLQIAGDYFKAAYGTNQSDANANNHISILEDWDNNDPAYVKAQGNNQLTMDFPMHLALKYSLNMPSSARSGLEPAISTSLVNRAADATENEAQPNYSFIRAHDSEVQTVIAQIIKDKINPSSDGLTVSTDEIAKAFEIYNADELKADKEYTAYNIPSSYALMLTNKDTIPRVYYGDLFTDDGQYMSAKSPYYDALTSLLQSRVKYVSGGQSMNMTYLHNNQGLLTSVRYGKDAMTANDTGTSETRTQGIGLIVGNKTDLNLNNDEQIVLNMGAAHKNQAYRALMLSTKDGLKIYNNDDEAPVSYTDDQGRLIFKSDVVYGVSDAQVSGYLAAWVPVGANDSQDARTESSTTASTDGNTYHSNSALDSQLIYEGFSNFQAMPTQADEYTNIKIAENAQLFKSLGITSFELAPQYRSSTDNSFLDSVIQNGYAFTDRYDIGYNTPTKYGTVDQLLDALRALHAQGIQAINDWVPDQIYNLPGEEIVTASRTNGSGKVNESSVINNTLYDSRTVGGGEYQAIYGGAFLDKLKQDYPELFETKQISTGEAMNPDVKITEWSAKYFNGSNIQGRGAWYVLKDWSTNQYFNVSSGSEFLPKQLLGEKTSTGFTNVDNGKTEFYSTSGYQAKNTFIQDNDNWYYFDNDGYMVVGGQEINGKKYYFLPNGVELQDAYLSDGTSEYYYSSDGRQISNQYYQGSDNNWRYFFADGHMAVGLATITTENGTTNQQYFDANGVQLKGVAIKDTDGNVHYFDGKTGNMVINSWGKISDGSWLYLNDSGVAVTGPQNINGQNLYFNEDGIQVKGEAITDNSGNIHYYDRSTGNMVVNSWGETNNGSWLYLNDKGDAVTGEQVIDGQKLYFSSNGIQLKNTFKKLSDGSWLYLNDKGLPVTGAQVIDGQNLYFDQDGKQVKGDVATDGQGNTHYYDGNTGNMVTNSWAELPDGSWMYLDNDGNPLTGQQKIDGQSLYFNDAGKQIKNALVKLDDGSTIYLDDKGVSSTGIQRIDDKIYYFDPDGKQVVCRFEELPDGSWMYLDDDGVAATGAQKINGQELYFDNSGKQVKNDKVINDDGTINYYTGMSGEKLKNDFGELPDGSWMYLDNQGNAVIGAQKINGQNLYFKTDGRQVKGEANVDSSGEMHFYDPDSGELITNRFEQVASGVWAYFDAKGVAVTGEQRIGKQNLFFDPTGYQVKGDKRTIDGVLYTFDKESGERKGLDSISVLPTNGQYTTDKAQNWYYQVDGENVKGLYTNNDGQLRYFDLTTGVQTKGNFVTIGNDTYYFTKEQGDGQIVSEVVSGHYGTVQLSDNSSAWVYRGANDQILKGLQNINGRLQYFDLTTGAQLKGGAANYDGNLYYFESSDGNLVSKIQQSYSTGNYVTDGDKVTYADEQNNQVTGLALIDDQLQYFDPSDGRQVKNEQVIVDGVTYYFDKNGNGQYLFTNTATMSTNEFAKHSAAYSNDSSSFKNTIDGFLTADTWYRPKDILENGQTWVVSSTNDVRPLITVWWLNKDVQVNYSNFMKQNGLLDTSSQFNLQSDQYDLNVAAQKVQVAIEKRISKEKSTDWLKDLLFEAHEDTPSFVKQQFIWNKDSEYQGQGDAWFQGGYLKYGNNELTPTTNSDYRESGNTLDFLLANDVDNSNPAVQAENLNWLHYLMNFGTITANDDDANFDSIRIDAVDFIDNDAIQRTYDYMRDAYKVDASEDNANKHISLVEAGLDAGTSTIKSDALVESNFREAATLSLANQSGENSSLTNMLQDIDGGQIIADHANNATENESTPNYSIIHAHDKGIQEKVGAAITDVTGADWTNFTDDQLKEGLAAYYQDQRSTNKKYNIYNLPSIYALMLTNKDTVPRVYYGDMYQDDGQYMEKQSIYYDAIVSLMNTRKSYVSGGQTMDVDEHGLLKSVRFGKDAMTASDLGTNETRTEGVGVLVGNDSSLKLNDSDTVTLEMGAAHKNQKYRAALLTTSDGIVTYDADNDAPTIWTDDRGTLTFSNKEIAGQDYTSVQGFANSQVSGYLAVWVPVGASDDQDVRTAALTDANLDDKVLHSNAALDSNLIYEGFSNFQPKATTNDELTNVVIAKNANLFEKWGITSFEMAPQYRSSGDHTFLDSTIDNGYAFTDRYDLGFETPTKYGTDKDLRTAIKALHQSNMQVMADVVDNQVYNLSGQEVVSASRAGVYGNDVSTGFGTQLYAVNSVGGGKYQAQYGGEYLNELKQQYPDLFEAKTYDYWVKNYSNDGSDPYYTLSQNTRKDMPSSEVIKQWSAKYMNGTNVLGNGMGYVLKDWNTGEYFKIGEKNADFITN

SEQ ID NO: 2 - protein, 2835 aa, Leuconostoc mesenteroides
MRDMRVICDRKKLYKSGKVLVTAGIFALMMFGVTTASVSANTIAVDTNHSRTSAQINKSAVDKVNDDKTTLGAAKVVAVATTPATPVADKTVSAPAADKAVDTTSSTTPATDKAVDTTPTTPAADKAVDTTPTTPAADKAVDTTPTTPAANKAVDTTPATAATDKAVATPATPAADKLANTTPATDKAVATTPATPVANKAADTSSIHDQPLDTNVPTDKSANLVSTTQKSTDNQQVKSTETSHLQEINGKTYFLDDNGQVKKNFTAIIDGKVLYFDKTSGELTANAPQVTKGLVNIDNAHNAAHDLTADNFTNVDGYLTANSWYRPKDILKNGTTWTPTTAEDFRPLLMSWWPDKNTQVAYLQYMQSVGMLPDDVKVSNDDNMSTLTDAAMTVQKNIESRIGVSGKTDWLKQDMNKLIDSQANWNIDSESKGNDHLQGGALLYVNDDKTPNANSDYRLLNRTPTNQTGQITDPSKQGGYEMLLANDVDNSNPVVQAEQLNWLHYMMNIGTIAQNDPTANFDGYRVDAVDNVDADLLQIAGDYFKAAYGTGKTEANANNHISILEDWDNNDSAYIKAHGNNQLTMDFPAHLALKYALNMPLAAQSGLEPLINTSLVKRGKDATENEAQPNYAFIRAHDSEVQTVIAQIIKDKINTKSDGLTVTPDEIKQAFTIYNADELKADKEYTAYNIPASYAVLLTNKDTVPRVYYGDLFSDDGQYMSQKSPYYDAITSLLKSRIKYVAGGQSMNMTYLHECFDPAKNETKPQGVLTSVRYGKGAMTADDLGNSDTRQQGIGLVINNKPFLNLNDDEQIVLNMGAAHKNQAYRPLMLTTKSGLQIYDKDAGAPVVYTNDAGQLIFKSDMVYGVSNPQVSGYFAAWVPVGASDSQDARTQSSQSETKDGDVYHSNAALDSNVIYEGFSNFQAMPEKNDDFTNVKIAQNAKLFKDLGITSFELAPQYRSSTDNSFLDSVIQNGYAFTDRYDVGYNTPTKYGTVDQLLDSLRALHAQGIQAINDWVPDQIYNLPGEQIVTAVRTNGSGKYDYDSVINNTLYDSRTVGGGEYQEKFGGLFLDQLKKDYPSLFETKQISTNQPMNPDVKIKEWSAKYFNGSNIQGRGAWYVLKDWATNQYFNVSSDNGFLPKQLLGEKTSTGFITENGKTSFYSTSGYQAKDTFIQDGTNWYYFDNAGYMLTGKQNIHDKNYYFLPNGVELQDAYLFDGNQEFYYNKAGEQVMNQYYQDSQNQWHYFFENGRMAIGLTEVPNADGTHVTQYFDANGVQIKGTAIKDQNNQLRYFDEATGNMVVNSWGQLADKSWLYLNAQGVAVTGNQKIDGEEYYFNADGKQVKGNAIIDNNGDQRYYDGDKGVMVVNSWGELPDGSWLYLNDKGIAVTGRQVINNQVNFFGNDGKQIKDAFKLLSDGSWVYLDDKGLITTGAKVINGLNMFFDKDGHQIKGDASTDANGKRHYYDKNDGHLVTNSWGELPDGSWLYLEEQGDAVTGQRVIDGKTRYFDEDGKQIKNSLKTLANGDKIYLDGDGVAATGLQHVGDKIMYFDEDGKQVVGKFVSAKDGSWYYLNQDGVAAVGPSSINGQSLYFDQDGKQVKYNEVRNSDGTTNYYTGLTGEKLTQDFGELPDGSWIYLDAQGHTVTGAQIINGQNLYFKADGQQVKGHAYTDQLGHMRFYDPDSGDMLSNRFEQITPGVWAYFGADGVAITGQHDINGQKLFFDETGYQVKGSQRTIDGTLYSFDSQTGNQKRVQTTLLPQAGHYITKNGNDWQYDTNGELAKGLRQDSNGKLRYFDLTTGIQAKGQFVTIGQETYYFSKDHGDAQLLPMVTEGHYGTITLKQGQDTKTAWVYRDQNNTILKGLQNINGTLQFFDPYTGEQLKGGVAKYDDKLFYFESGKGNLVSTVAGDYQDGHYISQDGQTRYADKQNQLVKGLVTVNGALQYFDNATGNQIKNQQVIVDGKTYYFDDKGNGEYLFTNTLDMSTNAFSTKNVAFNHDSSSFDHTVDGFLTADTWYRPKSILANGTTWRDSTDKDMRPLITVWWPNKNVQVNYLNFMKANGLLTTAAQYTLHSDQYDLNQAAQDVQVAIERRIASEHGTDWLQKLLFESQNNNPSFVKQQFIWNKDSEYHGGGDAWFQGGYLKYGNNPLTPTTNSDYRQPGNAFDFLLANDVDNSNPVVQAENLNWLHYLMNFGTITAGQDDANFDSIRIDAVDFIHNDTIQRTYDYLRDAYQVQQSEAKANQHISLVEAGLDAGTSTIHNDALIESNLREAATLSLTNEPGKNKPLTNMLQDVDGGTLITDHTQNSTENQATPNYSIIHAHDKGVQEKVGAAITDATGADWTNFTDEQLKAGLELFYKDQRATNKKYNSYNIPSIYALMLTNKDTVPRMYYGDMYQDDGQYMANKSIYYDALVSLMTARKSYVSGGQTMSVDNHGLLKSVRFGKDAMTANDLGTSATRTEGLGVIIGNDPKLQLNDSDKVTLDMGAAHKNQKYRAVILTTRDGLATFNSDQAPTAWTNDQGTLTFSNQEINGQDNTQIRGVANPQVSGYLAVWVPVGASDNQDARTAATTTENHDGKVLHSNAALDSNLIYEGFSNFQPKATTHDELTNVVIAKNADVFNNWGITSFEMAPQYRSSGDHTFLDSTIDNGYAFTDRYDLGFNTPTKYGTDGDLRATIQALHHANMQVMADVVDNQVYNLPGKEVVSATRAGVYGNDDATGFGTQLYVTNSVGGGQYQEKYAGQYLEALKAKYPDLFEGKAYDYWYKNYANDGSNPYYTLSHGDRESIPADVAIKQWSAKYMNGTNVLGNGMGYVLKDWHNGQYFKLDGDKSTLPQI

SEQ ID NO: 3 - DNA, 8268 bp, Leuconostoc mesenteroides
atggctagcgctgatagcactaacaacactggtgttacggtgtcacaagcaacagataaagtagcagacacgacggctacaacggacaaagtagcggacacaacagctacaacagataaagtggccgacacagcagctacaacggacaaagtagcggacacaacagctacaacagataaagtggccgacacagcagctacaacggacaaagtagcggacacaacagctacaacagataaagtggccgacacagcagctgcaacagataaagcagccgatacagcggctacaacggataaagtggccgacacagcagctgcaacggataaagtagcggacacagtagctgcaacggacaaagtagcggacacaacagctacaacagataaagcagccgatacagcggctacaacggataaagtaaccgacacaacagctgcaacggataaagcagcggacacgacggctacaacagataaagtggccgacacaacagccacaacatcagaaaaatcaaaaagtattaaacaaattgatggtaaaacttatttcattggtaatgatggtcagcctaagaaaaattttacagccattgttgacggtcaagtattatatttcgacaaagatactggtgctttgacatcaaatagtagtcaatataccgatggtttagccaatataggaaatgagcataatgcggcttattcattgtcttcggatagttttacacaagttgatggctatctaacggctaacagttggtaccgacctaaagatatattaaaaaatggtacaacttggacggctgcaacagcaaacgattttcgaccattgttaatgtcttggtggccagataaagatacccaagtttcatacttaaaatatatgcaatctgcgggattattatcagatgacgttgcattatcaaacaatgatagtatgaacagtttgacggatacggctatgactgttcaaaaaaaaattgaagaaaaaattggcttattgggcagtactgactggcttaaggccgatatgaaccaaatggttgattcacaatcgaattggaacattagtagtgagtctaaaggaacagatcatttgcaaggtggtgcgctcctatacgttaatagtgatttaacaccaaatgccaattctgattatcgtttattaaatcgaacgccaactaaccaaaaaggtcaaattacaacaaatggtaatcaaggtggctatgagatgctgttggccaacgatgttgataattctaacccaattgttcaagctgaacaattaaattggttatactacatgatgaatatcggtagcatcgcccaaaatgatccaacagcaaattttgacggttacagagttgatgctgttgataacgtgaatgctgacttgttgcaaattgctggagattattttaaagcagcatatggaacaaatcaaagtgacgctaatgcaaacaatcacatttccatcttagaagactgggacaataatgatccagcgtatgtaaaagcacaggggaacaaccaattaaccatggattttccaatgcatttggcattgaagtattcattgaatatgccaagtagtgctcgtagcggtttggaaccagcaatttcaacaagcctagtaaatcgtgcagcagacgccacagaaaatgaagcccaaccgaactattcatttattcgtgcacatgatagtgaagtacaaacggttattgctcaaattattaaagataaaattaatcctagttccgatggattgactgtctcaacagatgaaattgccaaagcattcgaaatatataatgctgacgaattaaaggctgataaagagtataccgcatataatataccctcatcatatgcattgatgttaactaacaaagatacaattcctcgtgtgtattatggtgatttgtttacggatgatggacaatatatgtctgcaaaatcaccatattatgatgcacttacttcattgcttcaatcgcgagtaaaatatgtttcaggtggtcaatctatgaatatgacttaccttcataataatcaaggccttttgacgtcagttcgctatggaaaagacgccatgacagctaacgacactggtacaagtgaaacgcgcacacaaggtattggattaattgtcggcaacaaaactgatttaaacctgaataatgatgagcaaattgtacttaacatgggggccgcacacaaaaatcaagcataccgtgcattaatgttaagtactaaagatggcttgaaaatttataataatgatgacgaggcaccggtatcgtatacagatgaccaaggccgtttgatttttaaatctgatgtggtttatggtgtgagtgatgctcaggtttctggttatttagcagcttgggtgccagtcggtgcaaacgatagccaagatgctagaacagaaagtagtacaacagcgtcaacagatggtaatacctatcattcaaatagtgccttagattctcaacttatatatgaaggcttttcaaacttccaagccatgccaacacaggccgatgagtataccaatatcaagattgccgaaaatgcacaattattcaagagccttgggataacatcatttgaattggcacctcaataccgttcaagtacggataacagtttcttagattcagttattcaaaatggctatgccttcacggatcgctacgacattggttataatacgcctacaaagtacggtacagttgaccaactattagatgctttaagagcattgcatgctcaaggcattcaggctatcaatgattgggtcccagaccaaatttataatttgcctggggaagaaatagtgacagccagtcgaacaaacggttcgggaaaggtgaatgaaagttcagttattaataatacgctatatgattctcgtactgttggtggcggagagtatcaagcaatatatggaggtgctttcttagataagttaaaacaagattatcctgagttatttgaaacaaaacaaatttcaacaggtgaagcaatgaaccctgatgtcaaaatcacagaatggtcagctaagtattttaatggctcaaacattcaaggacgtggtgcatggtatgttctcaaggattggtcaacaaatcaatactttaatgtttcaagtggtagtgaatttttacctaagcaactgttaggcgaaaaaacaagtacagggtttaccaacgtggacaatggcaagactgagttttattctacgagtggctaccaagcaaagaatacatttattcaagataatgacaattggtattattttgataatgatggctatatggttgttggcggtcaagaaattaatggtaaaaaatattatttcctaccaaatggtgtagagttacaagatgcttatttgtctgatgggacaagtgagtattactacagtagtgatggtcgtcaaatttctaatcaatattatcaaggatcagacaacaactggcgttatttctttgcagatggtcatatggctgtagggttagcaacaattactacagaaaatggtacaacaaatcaacaatatttcgatgcaaatggtgtgcaacttaagggcgtagctataaaggatactgatggcaatgtgcactattttgatggcaagacaggaaacatggttataaattcctggggtaaaataagcgatggttcatggttatacttaaatgatagcggtgtagcggtcacaggaccgcaaaatattaacggccaaaatctttacttcaacgaagacggtattcaagtaaagggtgaagccattactgataatagtggaaacatacattattatgatcgcagcacaggaaatatggttgtgaactcatggggtgaaacgaataatggttcatggctatacttgaacgacaagggtgatgccgttacaggagaacaagttattgacggtcaaaaactatatttcagtagtaatggaatccaacttaaaaatacattcaagaagctatccgatggttcatggctatatttgaacgataaaggtcttccagtgacaggagcacaggtcattgatggacaaaacttgtatttcgaccaagatgggaagcaagtcaagggtgacgttgctacagatggacaaggtaacactcattattatgatggcaacacaggaaatatggttactaattcatgggcagagttaccggacggttcatggatgtatctggacaatgatggcaatcctttaacaggacagcaaaagattgatggccagtcactctactttaatgatgctggtaagcaaatcaaaaacgcattggttaaactagatgatgggtcaacaatttacctcgatgataaaggtgtttcatcaactggtattcaaagaattgatgataagatatattattttgatcctgatggtaaacaagtagtatgtcgttttgaagaattaccagatggttcatggatgtatctagatgatgacggtgttgctgctacgggcgctcaaaaaattaatggccaggaattatatttcgacaatagcgggaaacaagtcaagaacgacaaagtaattaatgacgatggaacaataaactattacacaggtatgagcggtgaaaaactaaaaaatgattttggtgaattaccagacggttcatggatgtacttggataatcaaggtaatgctgtaataggtgcccaaaaaattaatggccagaatctttacttcaagacagacggacgacaggttaagggtgaagcaaatgttgattcatcaggtgaaatgcacttctatgatcctgattctggcgagctaattacaaatagatttgaacaagttgctagtggtgtatgggcttactttgatgccaaaggtgttgctgtaactggtgagcaacgcattggtaagcaaaatttattttttgatccaactggttatcaagttaaaggcgacaaacgaacaattgacggcgttctctatacctttgataaagaaagtggtgagagaaagggtttagattctatatcggtattacccaccaatggacaatacacaaccgataaggcccaaaattggtattaccaagtcgatggtgaaaatgtaaaagggctatatacaaataatgatggtcaattacgttacttcgatttgacaactggcgtgcagactaaaggtaattttgtgacaattggcaatgatacctactatttcaccaaggaacaaggggatggacagatagtttctgaggttgtgtcaggacactatggtactgtccagttgagtgacaattcgtctgcatgggtttatcgcggtgcaaatgatcaaattttgaaaggcctacagaatataaacggtcgtctgcaatattttgatctaaccaccggtgcgcaattaaaaggcggtgctgcaaactatgatggcaacctttattattttgaatcatcagatggtaacctagtcagtaaaattcagcaatcttattctactgggaattatgtgaccgatggtgataaagtaacatatgctgatgagcaaaacaaccaagtcacgggattagcgttgattgatgatcaactacaatacttcgatccaagtgacggtcgtcaagtcaagaatgagcaggttatcgttgatggcgtcacatactactttgataaaaatggtaatggacaatacttgtttacaaatactgcaacgatgtcaactaatgaatttgccaaacatagtgctgcttatagcaatgatagttctagcttcaagaatacgatagatggtttcttgacggccgatacctggtatcgccctaaagatatcttggaaaacggacaaacgtgggtagtttcttcaacaaatgacgtgcgaccactgataacagtttggtggctaaataaagatgttcaagttaattattcaaattttatgaagcaaaatggtttgctagatacaagtagtcaatttaatctacaatctgatcaatatgacttgaatgtcgccgcgcaaaaagttcaagtggctattgaaaaacgcatttcgaaagaaaagagtacagattggttgaaagatcttttgtttgaagctcatgaagatacgccttcatttgtgaaacaacaatttatttggaataaagattctgaatatcaaggtcaaggggatgcgtggttccaaggtggttatctgaaatatggtaacaatgaattaaccccaacaacgaactcagattatcgtgaatccggtaatacattagacttcttgcttgctaatgatgtcgacaattctaacccagcggttcaagctgaaaatttgaattggttacattatttaatgaactttggcacgattacagctaatgatgatgatgctaattttgacagtattcgtattgatgccgttgactttattgataatgatgccattcagagaacctacgattacatgcgtgatgcttataaagttgatgcaagtgaagacaacgctaataagcatatttcactggtggaagctggattagatgctggtacctctacaattaagagtgatgctttagttgaatctaactttagagaggcagctacactatcgctggcaaatcaatcaggggaaaatagttccttgactaatatgttgcaagacattgatggtggccagattatagctgatcacgccaacaatgcaacagaaaatgaatcaacgccaaattattcaattattcatgctcatgataaggggattcaagaaaaggttggtgcagcaattaccgacgttactggtgcagactggacgaatttcaccgatgaccaattaaaagaaggattagcagcttattatcaagatcaacgttcaacgaataaaaagtataacatctataacttacctagtatctatgctttaatgttgaccaataaggacacagttcctcgtgtttattacggtgatatgtatcaagatgatggccagtatatggaaaagcaaagtatttattatgatgccattgtttccttgatgaacactagaaagagttatgtgagtggtgggcaaactatggatgtagatgaacatggtttgttgaagagtgttcgttttggtaaagacgcaatgacagctagtgaccttggtacgaatgaaacacgcactgaaggtgttggtgtgctggtcggcaatgattcttcactaaaactaaatgattcagatacagttactttagagatgggggcggctcataaaaaccaaaagtaccgagctgcattgttgacaacaagcgatggtattgttacgtatgatgctgataatgatgcaccaacaatctggacagatgaccgtggtacattgacgttctcaaataaggagattgctggtcaagattatacaagcgtgcaaggattcgctaattcacaagtatcaggttacttagcagtttgggtgcccgtaggagctagtgacgatcaagatgtccgaacagcagcattaacagatgcaaatcttgatgacaaagtactgcattctaatgctgcattagattcgaacttgatttacgaaggcttttctaactttcaacctaaagcaaccaccaatgatgaattgactaacgtagtaattgctaaaaatgctaatttatttgaaaagtggggaatcacaagttttgagatggcaccacaatatcgttcaagtggggaccacacgttcttagattcaacgattgataatggttatgcatttactgaccgatacgatttgggatttgaaacaccaactaagtacggtactgataaggatttgcgtactgcaattaaagcattgcaccaatcaaatatgcaggttatggctgatgtagttgataaccaagtttataatttatctggacaggaggtcgtatcagcttcacgtgccggtgtttacggcaatgatgtgtcaactggatttgggacacaactctatgcggttaatagtgttggtggtggtaaatatcaagcccaatacggtggtgaatatttgaatgaattgaagcaacaatacccagatttgttcgaagctaagacgtatgactattgggttaaaaattattcaaatgacggatcggatccgtattacacactgtcgcaaaacacacgaaaagatatgccaagtagtgaggtcattaaacaatggtcagctaaatatatgaatggtactaatgtattaggaaacggtatgggatatgttttgaaagattggaatacaggtgagtatttcaaaattggagaaaagaatgctgattttataacaaattaa

SEQ ID NO: 4 - protein, 2755 aa, Leuconostoc mesenteroides
MASADSTNNTGVTVSQATDKVADTTATTDKVADTTATTDKVADTAATTDKVADTTATTDKVADTAATTDKVADTTATTDKVADTAAATDKAADTAATTDKVADTAAATDKVADTVAATDKVADTTATTDKAADTAATTDKVTDTTAATDKAADTTATTDKVADTTATTSEKSKSIKQIDGKTYFIGNDGQPKKNFTAIVDGQVLYFDKDTGALTSNSSQYTDGLANIGNEHNAAYSLSSDSFTQVDGYLTANSWYRPKDILKNGTTWTAATANDFRPLLMSWWPDKDTQVSYLKYMQSAGLLSDDVALSNNDSMNSLTDTAMTVQKKIEEKIGLLGSTDWLKADMNQMVDSQSNWNISSESKGTDHLQGGALLYVNSDLTPNANSDYRLLNRTPTNQKGQITTNGNQGGYEMLLANDVDNSNPIVQAEQLNWLYYMMNIGSIAQNDPTANFDGYRVDAVDNVNADLLQIAGDYFKAAYGTNQSDANANNHISILEDWDNNDPAYVKAQGNNQLTMDFPMHLALKYSLNMPSSARSGLEPAISTSLVNRAADATENEAQPNYSFIRAHDSEVQTVIAQIIKDKINPSSDGLTVSTDEIAKAFEIYNADELKADKEYTAYNIPSSYALMLTNKDTIPRVYYGDLFTDDGQYMSAKSPYYDALTSLLQSRVKYVSGGQSMNMTYLHNNQGLLTSVRYGKDAMTANDTGTSETRTQGIGLIVGNKTDLNLNNDEQIVLNMGAAHKNQAYRALMLSTKDGLKIYNNDDEAPVSYTDDQGRLIFKSDVVYGVSDAQVSGYLAAWVPVGANDSQDARTESSTTASTDGNTYHSNSALDSQLIYEGFSNFQAMPTQADEYTNIKIAENAQLFKSLGITSFELAPQYRSSTDNSFLDSVIQNGYAFTDRYDIGYNTPTKYGTVDQLLDALRALHAQGIQAINDWVPDQIYNLPGEEIVTASRTNGSGKVNESSVINNTLYDSRTVGGGEYQAIYGGAFLDKLKQDYPELFETKQISTGEAMNPDVKITEWSAKYFNGSNIQGRGAWYVLKDWSTNQYFNVSSGSEFLPKQLLGEKTSTGFTNVDNGKTEFYSTSGYQAKNTFIQDNDNWYYFDNDGYMVVGGQEINGKKYYFLPNGVELQDAYLSDGTSEYYYSSDGRQISNQYYQGSDNNWRYFFADGHMAVGLATITTENGTTNQQYFDANGVQLKGVAIKDTDGNVHYFDGKTGNMVINSWGKISDGSWLYLNDSGVAVTGPQNINGQNLYFNEDGIQVKGEAITDNSGNIHYYDRSTGNMVVNSWGETNNGSWLYLNDKGDAVTGEQVIDGQKLYFSSNGIQLKNTFKKLSDGSWLYLNDKGLPVTGAQVIDGQNLYFDQDGKQVKGDVATDGQGNTHYYDGNTGNMVTNSWAELPDGSWMYLDNDGNPLTGQQKIDGQSLYFNDAGKQIKNALVKLDDGSTIYLDDKGVSSTGIQRIDDKIYYFDPDGKQVVCRFEELPDGSWMYLDDDGVAATGAQKINGQELYFDNSGKQVKNDKVINDDGTINYYTGMSGEKLKNDFGELPDGSWMYLDNQGNAVIGAQKINGQNLYFKTDGRQVKGEANVDSSGEMHFYDPDSGELITNRFEQVASGVWAYFDAKGVAVTGEQRIGKQNLFFDPTGYQVKGDKRTIDGVLYTFDKESGERKGLDSISVLPTNGQYTTDKAQNWYYQVDGENVKGLYTNNDGQLRYFDLTTGVQTKGNFVTIGNDTYYFTKEQGDGQIVSEVVSGHYGTVQLSDNSSAWVYRGANDQILKGLQNINGRLQYFDLTTGAQLKGGAANYDGNLYYFESSDGNLVSKIQQSYSTGNYVTDGDKVTYADEQNNQVTGLALIDDQLQYFDPSDGRQVKNEQVIVDGVTYYFDKNGNGQYLFTNTATMSTNEFAKHSAAYSNDSSSFKNTIDGFLTADTWYRPKDILENGQTWVVSSTNDVRPLITVWWLNKDVQVNYSNFMKQNGLLDTSSQFNLQSDQYDLNVAAQKVQVAIEKRISKEKSTDWLKDLLFEAHEDTPSFVKQQFIWNKDSEYQGQGDAWFQGGYLKYGNNELTPTTNSDYRESGNTLDFLLANDVDNSNPAVQAENLNWLHYLMNFGTITANDDDANFDSIRIDAVDFIDNDAIQRTYDYMRDAYKVDASEDNANKHISLVEAGLDAGTSTIKSDALVESNFREAATLSLANQSGENSSLTNMLQDIDGGQIIADHANNATENESTPNYSIIHAHDKGIQEKVGAAITDVTGADWTNFTDDQLKEGLAAYYQDQRSTNKKYNIYNLPSIYALMLTNKDTVPRVYYGDMYQDDGQYMEKQSIYYDAIVSLMNTRKSYVSGGQTMDVDEHGLLKSVRFGKDAMTASDLGTNETRTEGVGVLVGNDSSLKLNDSDTVTLEMGAAHKNQKYRAALLTTSDGIVTYDADNDAPTIWTDDRGTLTFSNKEIAGQDYTSVQGFANSQVSGYLAVWVPVGASDDQDVRTAALTDANLDDKVLHSNAALDSNLIYEGFSNFQPKATTNDELTNVVIAKNANLFEKWGITSFEMAPQYRSSGDHTFLDSTIDNGYAFTDRYDLGFETPTKYGTDKDLRTAIKALHQSNMQVMADVVDNQVYNLSGQEVVSASRAGVYGNDVSTGFGTQLYAVNSVGGGKYQAQYGGEYLNELKQQYPDLFEAKTYDYWVKNYSNDGSDPYYTLSQNTRKDMPSSEVIKQWSAKYMNGTNVLGNGMGYVLKDWNTGEYFKIGEKNADFITN

SEQ ID NO: 5 - DNA, 3324 bp, Leuconostoc mesenteroides
gttaaaggcgacaaacgaacaattgacggcgttctctatacctttgataaagaaagtggtgagagaaagggtttagattctatatcggtattacccaccaatggacaatacacaaccgataaggcccaaaattggtattaccaagtcgatggtgaaaatgtaaaagggctatatacaaataatgatggtcaattacgttacttcgatttgacaactggcgtgcagactaaaggtaattttgtgacaattggcaatgatacctactatttcaccaaggaacaaggggatggacagatagtttctgaggttgtgtcaggacactatggtactgtccagttgagtgacaattcgtctgcatgggtttatcgcggtgcaaatgatcaaattttgaaaggcctacagaatataaacggtcgtctgcaatattttgatctaaccaccggtgcgcaattaaaaggcggtgctgcaaactatgatggcaacctttattattttgaatcatcagatggtaacctagtcagtaaaattcagcaatcttattctactgggaattatgtgaccgatggtgataaagtaacatatgctgatgagcaaaacaaccaagtcacgggattagcgttgattgatgatcaactacaatacttcgatccaagtgacggtcgtcaagtcaagaatgagcaggttatcgttgatggcgtcacatactactttgataaaaatggtaatggacaatacttgtttacaaatactgcaacgatgtcaactaatgaatttgccaaacatagtgctgcttatagcaatgatagttctagcttcaagaatacgatagatggtttcttgacggccgatacctggtatcgccctaaagatatcttggaaaacggacaaacgtgggtagtttcttcaacaaatgacgtgcgaccactgataacagtttggtggctaaataaagatgttcaagttaattattcaaattttatgaagcaaaatggtttgctagatacaagtagtcaatttaatctacaatctgatcaatatgacttgaatgtcgccgcgcaaaaagttcaagtggctattgaaaaacgcatttcgaaagaaaagagtacagattggttgaaagatcttttgtttgaagctcatgaagatacgccttcatttgtgaaacaacaatttatttggaataaagattctgaatatcaaggtcaaggggatgcgtggttccaaggtggttatctgaaatatggtaacaatgaattaaccccaacaacgaactcagattatcgtgaatccggtaatacattagacttcttgcttgctaatgatgtcgacaattctaacccagcggttcaagctgaaaatttgaattggttacattatttaatgaactttggcacgattacagctaatgatgatgatgctaattttgacagtattcgtattgatgccgttgactttattgataatgatgccattcagagaacctacgattacatgcgtgatgcttataaagttgatgcaagtgaagacaacgctaataagcatatttcactggtggaagctggattagatgctggtacctctacaattaagagtgatgctttagttgaatctaactttagagaggcagctacactatcgctggcaaatcaatcaggggaaaatagttccttgactaatatgttgcaagacattgatggtggccagattatagctgatcacgccaacaatgcaacagaaaatgaatcaacgccaaattattcaattattcatgctcatgataaggggattcaagaaaaggttggtgcagcaattaccgacgttactggtgcagactggacgaatttcaccgatgaccaattaaaagaaggattagcagcttattatcaagatcaacgttcaacgaataaaaagtataacatctataacttacctagtatctatgctttaatgttgaccaataaggacacagttcctcgtgtttattacggtgatatgtatcaagatgatggccagtatatggaaaagcaaagtatttattatgatgccattgtttccttgatgaacactagaaagagttatgtgagtggtgggcaaactatggatgtagatgaacatggtttgttgaagagtgttcgttttggtaaagacgcaatgacagctagtgaccttggtacgaatgaaacacgcactgaaggtgttggtgtgctggtcggcaatgattcttcactaaaactaaatgattcagatacagttactttagagatgggggcggctcataaaaaccaaaagtaccgagctgcattgttgacaacaagcgatggtattgttacgtatgatgctgataatgatgcaccaacaatctggacagatgaccgtggtacattgacgttctcaaataaggagattgctggtcaagattatacaagcgtgcaaggattcgctaattcacaagtatcaggttacttagcagtttgggtgcccgtaggagctagtgacgatcaagatgtccgaacagcagcattaacagatgcaaatcttgatgacaaagtactgcattctaatgctgcattagattcgaacttgatttacgaaggcttttctaactttcaacctaaagcaaccaccaatgatgaattgactaacgtagtaattgctaaaaatgctaatttatttgaaaagtggggaatcacaagttttgagatggcaccacaatatcgttcaagtggggaccacacgttcttagattcaacgattgataatggttatgcatttactgaccgatacgatttgggatttgaaacaccaactaagtacggtactgataaggatttgcgtactgcaattaaagcattgcaccaatcaaatatgcaggttatggctgatgtagttgataaccaagtttataatttatctggacaggaggtcgtatcagcttcacgtgccggtgtttacggcaatgatgtgtcaactggatttgggacacaactctatgcggttaatagtgttggtggtggtaaatatcaagcccaatacggtggtgaatatttgaatgaattgaagcaacaatacccagatttgttcgaagctaagacgtatgactattgggttaaaaattattcaaatgacggatcggatccgtattacacactgtcgcaaaacacacgaaaagatatgccaagtagtgaggtcattaaacaatggtcagctaaatatatgaatggtactaatgtattaggaaacggtatgggatatgttttgaaagattggaatacaggtgagtatttcaaaattggagaaaagaatgctgattttataacaaattaa

SEQ ID NO: 6 - protein, 1107 aa, Leuconostoc mesenteroides
MKGDKRTIDGVLYTFDKESGERKGLDSISVLPTNGQYTTDKAQNWYYQVDGENVKGLYTNNDGQLRYFDLTTGVQTKGNFVTIGNDTYYFTKEQGDGQIVSEVVSGHYGTVQLSDNSSAWVYRGANDQILKGLQNINGRLQYFDLTTGAQLKGGAANYDGNLYYFESSDGNLVSKIQQSYSTGNYVTDGDKVTYADEQNNQVTGLALIDDQLQYFDPSDGRQVKNEQVIVDGVTYYFDKNGNGQYLFTNTATMSTNEFAKHSAAYSNDSSSFKNTIDGFLTADTWYRPKDILENGQTWVVSSTNDVRPLITVWWLNKDVQVNYSNFMKQNGLLDTSSQFNLQSDQYDLNVAAQKVQVAIEKRISKEKSTDWLKDLLFEAHEDTPSFVKQQFIWNKDSEYQGQGDAWFQGGYLKYGNNELTPTTNSDYRESGNTLDFLLANDVDNSNPAVQAENLNWLHYLMNFGTITANDDDANFDSIRIDAVDFIDNDAIQRTYDYMRDAYKVDASEDNANKHISLVEAGLDAGTSTIKSDALVESNFREAATLSLANQSGENSSLTNMLQDIDGGQIIADHANNATENESTPNYSIIHAHDKGIQEKVGAAITDVTGADWTNFTDDQLKEGLAAYYQDQRSTNKKYNIYNLPSIYALMLTNKDTVPRVYYGDMYQDDGQYMEKQSIYYDAIVSLMNTRKSYVSGGQTMDVDEHGLLKSVRFGKDAMTASDLGTNETRTEGVGVLVGNDSSLKLNDSDTVTLEMGAAHKNQKYRAALLTTSDGIVTYDADNDAPTIWTDDRGTLTFSNKEIAGQDYTSVQGFANSQVSGYLAVWVPVGASDDQDVRTAALTDANLDDKVLHSNAALDSNLIYEGFSNFQPKATTNDELTNVVIAKNANLFEKWGITSFEMAPQYRSSGDHTFLDSTIDNGYAFTDRYDLGFETPTKYGTDKDLRTAIKALHQSNMQVMADVVDNQVYNLSGQEVVSASRAGVYGNDVSTGFGTQLYAVNSVGGGKYQAQYGGEYLNELKQQYPDLFEAKTYDYWVKNYSNDGSDPYYTLSQNTRKDMPSSEVIKQWSAKYMNGTNVLGNGMGYVLKDWNTGEYFKIGEKNADFITN

SEQ ID NO: 7 - protein, 1338 aa, Streptococcus criceti
MEKNLRYKLHKVKKQWVAIGVTTFAVGFLAGGQVVAADATDGNGGNTQVAHLIPKEPTDYKFDTPSGILTGLNFANAQTSPAGDNAGANQPAGGIEPQTAENAATDGQAVPQTSDQPGHLENVDGKTYYVDANGQRLKNYSTVIDGKTYYFDAQTGQAQAETPQINQNDNQVAPDTYAANNQAFTNDVSSFETVDNYVTADSWYRPRKILKNGESWQASAESDMRPILMTWWPDAATKAAYANYWVKEGLISGSYSPNSANLETAVQTIQAAIEKKIASEGSTAWLRDKMSQFVKSQNQWSLASENPTVYPNQDHLQGGALLFSNNEATAHANSDWRLLNRNPTFQTGKQKYFTTNYAGYELLLANDVDNSNPIVQAEQLNHFHYLMNWGEIVMGDKNANFDGVRVDAVDNVNADLLQIQRDYYKAKYGVDQNEKNAIDHLSILEAWSGNDNDYVKDQNNFSLSIDNSQRSYMLAAFAYPASQRGNDYISLLPKVGLKDRRYAKNGNPVPNYVFIRAHDSEVQTRIAKIIRERLGKTNADGLTNITLDDLNKAFDIYNQDMKAVDKQYYPNNLPMAYAWMLQNKDTVTRVYYGDMYTDDGQYMETKTPFHDAIETLLKARIKYVAGGQTAGYVQGWGSGILTSVRYGKGADTAIDAGTAETRTSGMAVLINNKPNFQSYNGLTLDMGAAHKNQAYRPLLLSTKDGIATYLNDSDVSSNQYKYTDGQGRLNFSASELRSVANVQVSGMIQVWVPVGAADNQDVRVAPNTNRNNSSNIYTQSDALDSQVIYEGFSNFQAFAKTPEQYTNAVIAKNADLFKSWGITQFEMAPQYVSSEDGTFLDSVVLNGYAFSDRYDLAMSKNNKYGSKEDLANAIKGLHNAGIKVLSDWVPDQMYNLPGKEVVTATRVDQYGRPKAGATINRTPYVVNTKTYGDYQEQYGGKFLDELQKLYPSLFTTKQISTGKPIDPSVKITNWSAKYFNGSNILGRGAKYVLSDNNKYLNLGAGQFFLPTNLNNTYGQPQAPANGFISKNGGIHYIDNNGQEVKNQFKEIAGSWYYFDANGKMATGQTKIGNTTYLFMPNGKQLKEGVWYDGKKAYYYDDNGRTWTNKGFVEFKVNGQDKWRYFNGDGSIAVGLVSLDNRTLYFDAYGYQVKGQTLTINGKTYSFDANEGDLITGNTPSPEPNNQGAWEALGDNQWGYRKDGKLLTGSQTIAGQKVFFQPNGVQVKGGTAKDEAGVLRFYDRDQGHLAGKGWYSTADNNWVYVDDAGRVVTGLQKIGSQTLYFDDNGIQAKGKAIWDKDGNLRYFAAGSGDMITNRWYNIGDNQWYWFNNQGIASRW

SEQ ID NO: 8 - DNA, 3909 bp, Streptococcus criceti
gctgacgcgactgacggtaacggagggaatactcaagttgcccacttgattcctaaagagcctactgactataagttcgatactccaagtggaattctcactggtcttaattttgcgaatgctcaaacaagcccagcaggcgataatgctggtgctaatcaaccggcgggaggaatcgagcctcagactgctgaaaatgctgcaacagatggccaagctgttcctcaaactagtgaccagccaggtcatttggaaaatgtggatggcaaaacctactatgtagatgctaacggtcagcgtttgaaaaattattcaaccgtgattgatggcaagacttactattttgatgctcagactggtcaggctcaggccgaaacaccacagattaatcaaaatgataatcaggtggcaccagatacttatgcggctaataatcaggctttcaccaatgatgtttcaagttttgaaacggttgacaactatgtgacggcggattcttggtaccgtcctcgtaaaattttgaagaatggggaaagttggcaggctagcgctgaatcagacatgcgccccatcctgatgacttggtggcctgatgcagctactaaggctgcctatgctaattactgggttaaggaaggtttgatttcaggctcctattcaccaaactcagccaatcttgagacagccgtccaaactattcaggcagctattgagaagaaaattgcttcggaaggcagcacagcttggctgcgtgacaagatgtcgcaatttgttaaatcgcaaaatcaatggagtcttgcctctgaaaatccaactgtctatcctaatcaggatcacctgcaggggggagccttgctctttagcaataacgaagcaacggctcatgctaattctgattggcgtttgctcaaccgtaatcctaccttccaaacgggtaagcaaaaatatttcacaaccaactatgctggttatgaactgcttttggccaacgatgttgataattccaacccaattgttcaagcggaacagcttaatcatttccactacctcatgaactggggtgagattgtcatgggagataagaatgctaatttcgacggcgttcgggtcgatgcagtcgataatgttaatgctgatttgctacaaattcagcgggattactacaaggctaaatatggcgttgatcaaaatgaaaagaatgccattgatcacttatctattttagaggcttggtcgggtaatgataatgactatgttaaggatcagaacaacttctcgctgtctattgataattcacaacgtagctatatgctggcagcctttgcttatccggccagtcaacgggggaatgattacatcagcctgttacctaaagttggtctgaaggatcgccggtatgctaaaaatggtaatccagttccaaactatgtctttattcgtgcccatgactccgaagtccaaacgcgaattgcgaaaattattcgggaacgtctgggaaaaacgaacgccgatggcctgaccaatattactttagatgatttaaataaggcctttgatatttacaatcaagatatgaaggctgttgataagcagtactatccaaataatttgccaatggcttatgcttggatgttacaaaataaggatacagtaactcgtgtctattatggtgatatgtacaccgacgatggtcagtacatggaaactaagacgccattccatgatgccattgaaacgttgctcaaggcacgcattaaatatgtggctggcggtcaaacagctgggtatgtacaaggctggggcagcggtatcttaacctctgtgcgttatggtaagggagccgatactgctattgatgctgggacagcagaaactcgcacttctggcatggctgtcctgattaataataagcctaatttccaatcctataatggtttgacgcttgatatgggtgctgctcataagaatcaggcctaccgccctcttcttttatcaactaaggatggaattgcaacctatcttaatgatagtgatgttagcagcaatcagtacaaatatactgatgggcagggtcgtttgaatttcagcgcttctgaactgcgcagcgttgctaatgttcaagtctcaggaatgattcaggtttgggtacccgtgggtgccgctgacaatcaagatgttcgtgtagctcctaacaccaatcgcaataattcttccaatatctatactcaaagtgatgctctggattcccaagtgatctatgaaggtttctcaaacttccaagcttttgctaagacacctgaacaatacaccaatgcggtgattgctaagaatgcggatctctttaaatcatggggcattacccaatttgaaatggcaccgcagtacgtgtcatccgaagatggcactttcttggattctgttgttctcaatggttatgcctttagcgaccgttatgatctggctatgagtaagaataacaagtacggctccaaagaagatttggccaatgctatcaagggtctccataatgctggtattaaggtcttgtcggactgggtaccggatcagatgtataacctgccaggtaaagaagtcgtgactgcaacacgggttgaccaatacggtagacctaaggctggtgcgacgattaacaggacaccttatgtagttaataccaagacttatggtgattatcaagagcagtatggcggtaaattcttggatgaattgcagaagctttatccaagtctcttcacgactaagcagatttcaactggcaaaccaattgacccatcggtcaaaattactaactggtcagctaaatatttcaacggctctaatatcttaggacgtggggctaaatatgttctcagcgataataataagtacctcaatttaggtgccggtcaattcttcttaccaaccaatctcaataatacctacggtcagccacaagctccagctaatggtttcatttctaagaatggtggtattcattatattgataataatggtcaagaagtcaagaatcaatttaaggaaattgctggcagctggtattatttcgatgccaatggtaagatggctactggacaaaccaagattggcaatactacctacctcttcatgcctaatggtaagcagctcaaagaaggtgtttggtatgatggcaagaaggcttactattatgatgataacggtcgaacttggacaaataagggatttgtcgagttcaaggtaaacggtcaagataaatggcgttactttaacggtgatggctccatcgctgtcggtctcgtttctcttgataatcgtaccctctactttgacgcctatggctaccaagtcaagggtcaaactctgactatcaatggtaaaacttatagctttgatgccaatgaaggtgatttgattacggggaatacgccaagtccagaaccaaacaatcaaggagcttgggaagcactgggtgataaccaatggggctatcgcaaggatggcaagcttttgacaggcagccaaacgattgctggacaaaaagtcttcttccagcctaatggtgtccaagtcaagggtggcacggctaaggatgaagcaggagttcttcgcttttacgaccgtgatcaaggacatttagctggtaagggttggtactcaacagctgataacaactgggtttatgtcgatgatgctggtcgtgttgtcactggccttcaaaagattggaagccaaacgctctattttgatgataatggtatccaagctaagggtaaggctatctgggataaggacggtaatcttcgttattttgcagcaggttccggtgacatgattaccaaccgttggtataatatcggtgataaccaatggtactggttcaataaccaagggattgcttcaagatggtaa

SEQ ID NO: 9 - protein, 1365 aa, Streptococcus downei
MEKNLRYKLHKVKKQWVAIGVTTVTLSFLAGGQVVAADTNNNDGTSVQVNKMVPSDPKFDAQAQNGQLAQAMFKAANQADQTATSQVSPATDGRVDNQVTPAANQPAANVANQDVANPATDAGALNRQSAADTSTDGKAVPQTSDQPGHLETVDGKTYYVDANGQRLKNYSMVIDGKTYYFDGQTGEAQTDLPKTGQANQDNVPDSYQANNQAYSNEASSFETVDNYLTADSWYRPRKILKNGQSWQASSEGDLRPILMTWWPDAATKAAYANFWAKEGLISGSYRQNSANLDAATQNIQSAIEKKIASEGNTNWLRDKMSQFVKSQNQWSIASENETVYPNQDHMQGGALLFSNSKDTEHANSDWRLLNRNPTFQTGKQKYFTTNYAGYELLLANDVDNSNPVVQAEQLNHLHYLMNWGDIVMGDKDANFDGVRVDAVDNVNADLLQIQRDYYKAKYGTDQNEKNAIDHLSILEAWSGNDNDYVKDQNNFSLSIDNDQRSGMLKAFGYASAYRGNLSNLATAGLKNRSANPDSDPVPNYVFIRAHDSEVQTRIAKIIREKLGKTNADGLTNLTLDDLNKAFDIYNQDMNATDKVYYPNNLPMAYAWMLQNKDTVTRVYYGDMYTDNGQYMATKTPFYNAIETLLKGRIKYVAGGQAVSYKQDWSSGILTSVRYGKGANSASDAGNTETRNSGMALLINNRPNFRAYRNLTLNMGAAHKSQAYRPLLLSTKDGIATYLNDSDVDSRQYKYTDSQGNLSFSASELQSVANAQVSGMIQVWVPVGAADNQDVRTSPSTQATKDGNIYHQSDALDSQVIYEGFSNFQAFAQSPDQYTNAVIAKNGDLFKSWGITQFEMAPQYVSSEDGTFLDSVILNGYAFSDRYDLAMSKNNKYGSKQDLANAIKGLQSAGIKVLSDLVPNQLYNLPGKEVVTATRVNQYGQAKSGATINKTPYVANTRSYGDYQEQYGGKFLDDLQKLYPRLFSTKQISTGKPIDPSVKITNWSAKYFNGSNILGRGAKYVLSEGNKYLNLADGKLFLPTVLNNTYGQPQVSANGFISKNGGIHYLDKNGQEVKNRFKEISGSWYYFDSDGKMATGKTKIGNDTYLFMPNGKQLKEGVWYDGKKAYYYDDNGRTWTNKGFVEFRVDGQDKWRYFNGDGTIAIGLVSLDNRTLYFDAYGYQVKGQTVTINGKSYTFDADQGDLVQTDNANPAPQGQAGWKLLGDNQWGYRKDGQLLTGEQTIDGQKVFFQDNGVQVKGGTATDASGVLRFYDRDQGHQVGKGWYSTSDDNWVYVNESGQVLTGLQTIDGQTVYFDDKGIQAKGKAVWDENGNLRYFDADSGNMLRDRWKNVDGNWYYFNRNGLATRW

SEQ ID NO: 10 - protein, 1587 aa, Streptococcus salivarius
MRSKKLWISLLFALTLIFTMAFSNMSASAEETNNSNGSPSTTTVGENTNPVVEKEVGTTTEVANTSNATTTERAEVTADKPAETTVQPNSGTTTSDRAVAVEVEAKPETTAKPEVATKPETATTSEVAANAGVAAPTTEKSKELSEAEIKAAVSLDNIKKEKDGKYYYLLEDGSHKKNFAITVNGQVLYFDENGALSSTSTYSFTQETTNLVTDFTKNNAAYDSTKASFELVDGYLTADSWYRPKEILEAGTTWKASTEKDFRPLLMSWWPDKDTQVAYLNYMTKALSNGEETKDVFTIENSQASLNAAAQILQRKIEVKIAANKSTDWLRQSIEAFVKDQDKWNINSESPGKEHFQKGALLFVNSDSTKWANSDYRKLNQTATSYIKNHKIVNGSDGGYEFLLSNDIDNSNPVVQAEMLNQLYYFMNWGQIVFGDKDKDAHFDGIRVDAVDNVSVDMLQLVSSYMKAAYKVNESEARALANISILEAWSHNDPYYVNEHNTAALSMDNGLRLSIVHGLTRPVTNKGTGARNASMKDLINGGYFGLSNRAEVTSYDQLGFATYLFVRAHDSEVQTVIADIISKKIDPTTDGFTFTLDQLKQAFDIYNADMLKVDKEYTHSNIPAAYALMLQTMGAATRVYYGDLYTDNGQYMAKKSPYFDQITTLLKARPKYVAGGQTSYIHNLAGDGVSSAKDNKEVLVSVRYGQDLMSKTDTEGGKYGRNSGMLTLIANNPDLKLADGETITVNMGAAHKNQAYRPLLLGTDKGIVSSLNDSDTKVVKYTDAQGNLVFTADEIKGFKTVDMSGYLSVWVPVGATDDQNVLAKPSTKAYKEGDKVYSSSAALEAQVIYEGFSNFQDFVKEDSQYTNKLIAANADLFKSWGITSFEIAPQYVSSKDGTFLDSIIENGYAFTDRYDFAMSKNNKYGSKEDLRDALKALHKQGIQVIADWVPDQLYTLPGKEVVTATRTDTHGKVLDDTSLVNKLYVTNTKSSGNDFQAQYGGAFLDKLQKLYPEIFKEVMEASGKTIDPSVKIKQWEAKYFNGTNIQKRGSDYVLSDGKLYFTVNDKGTFLPAALTGDTKAKTGFAYDGTGVTYYTTSGTQAKSQFVTYNGKQYYFNDKGYLVTGEQTIDGSNYFFLPNGVMFTDGVRKNAKGQSLVYGKSGKLTTQTGWKEVTVKDDSGKEEKFYQYFFKGGIMATGLTEVEGKEKYFYDNGYQAKGVFVPTKDGHLMFFCGDSGERKYSGFFEQDGNWYYANDKGYVATGFTKVGKQNLYFNEKGVQVKNRFFQVGDATYYANNEGDVLRGAQTINGDELYFDESGKQVKGEFVNNPDGTTSYYDAITGVKLVDTSLVVDGQTFNVDAKGVVTKAHTPGFYTTGDNNWFYADSYGRNVTGAQVINGQHLYFDANGRQVKGGFVTNTDGSRSFYHWNTGDKLVSTFFTTGHDRWYYADDRGNVVTGAQVINGQKLFFDTDGKQVKGAFATNANGSRSYYHWNTGNKLVSTFFTSGDNNWYYADAKGEVVVGEQTINGQHLYFDQTGKQVKGATATNPDGSISYYDVHTGEKAINRWVKIPSGQWVYFNAQGKGYVSN

SEQ ID NO: 11 - protein, 1414 aa, Streptococcus sobrinus
MRSKKLWISLLFALTLIFTMAFSNMSASAIDGKYYYVQADGSYKKNFAITVNGQMLYFDSDTGALSSTSTYSFSQGTTNLVDDFSSHNKAYDSTAKSFELVNGYLTANSWYRPAGILRNGQTWEASNENDLRPVLMSWWPDKDTQVAYVNYMNKYLSANETEVTNETSQVDLNKEAQSIQTKIEQKITSDNSTQWLRTAMEAFVAAQPKWNMSTENFNKGDHLQGGALLYTNSDLTPWANSDYRLLNRTPTQQDGTKKYFTEGGEGGYEFLLSNDVDNSNPVVQAEQLNQLHYLMNWGDIVMGDKDANFDGVRVDAVDNVNADLLQVYSNYFKDNYKVTDSEANALAHISILEAWSLNDNQYNEDTNGTALSIDNSSRLTSLAVLTKQPGQRIDLSNLISESVNKERANDTAYGDTIPTYSFVRAHDSEVQTVIAKIVKEKIDTNSDGYTFTLDQLKDAFKIYNEDMAKVNKTYTHYNIPAAYALLLSNMESVPRVYYGDLYTDDGQYMAKKSPYYDAIATMLQGRIAYVSGGQSEEVHKVNGNNQILSSVRYGQDLMSADDTQGTDLSRTSGLVTLVSNDPNLDLGGDSLTVNMGRAHANQAYRPLILGTKDGVQSYLKDSDTNIVKYTDANGNLTFTADDIKGYSTVDMSGYLAVWVPVGAKDGQDVRVAADTNQKADGKSLKTSAALDSQVIYEGFSNFQDFANNDADYTNKKIAENADFFKKLGITSFEMAPQYVSATDGSFLDSIIQNGYAFSDRYDLAMSKNNKYGSKDDLANALKALHANGIQAIADWVPDQIYQLPGEEVVTAKRTNSYGNPTFDAYINNALYATNTKSSGSDYQAQYGGAFLDELKAKYPDMFTVNMISTGKPIDPSTKIKQWEAKYFNGTNVLGKGAGYVLSDDATGKYFTVNENGDFLPASFTGDQNAKTGFYYDGTGMAYYSTSGNKAVNSFIYEGGHYYYFDKDGHMVTGSYKAEDGNDYYFLPNGIQMRDAIYQDAQGNSYYYGRTGILYKGDNWYPFVDPNNANKTVFRYFDANNVMAIGYRNMYGQTYYFDENGFQAKGQLLTDDKGTHYFDEDNGAMAKNKFVNVGDDWYYMDGNGNAVKGQYPVNNQILYFNPETGVQVKGQFITDAQGRTSYYDANSGALKSSGFFTPNGSDWYYAENGYVYKGFKQVAENQDQWYYFDQTTGKQAKGAAKVDGRDLYFNPDSGVQVKGDFATDESGNTSFYHGDNGDKVVGGFFTTGNNAWYYADNNGNLVKGFQEIDGKWYHFDEVTGQQAKGAALVNGQQLYFDVDSGIQVKGDFVTDGQGNTSYYDVNSGDKKVNGFFTTGDNAWYYADGQGNLAKGRKSIDNQDLYFDPATGKQVKGQLVSIDGRNYYFDSGSGNMAKNRFVRIGDQWIYFGNDGAATNL

SEQ ID NO: 12 - protein, 1267 aa, Streptococcus mutans
MVNGKYYYYKEDGTLQKNYALNINGKTFFFDETGALSNNTLPSKKGNITNNDNTNSFAQYNQVYSTDAANFEHVDHYLTAESWYRPKYILKDGKTWTQSTEKDFRPLLMTWWPDQETQRQYVNYMNAQLGIHQTYNTATSPLQLNLAAQTIQTKIEEKITAEKNTNWLRQTISAFVKTQSAWNSDSEKPFDDHLQKGALLYSNNSKLTSQANSNYRILNRTPTNQTGKKDPRYTADRTIGGYEFLLANDVDNSNPVVQAEQLNWLHFLMNFGNIYANDPDANFDSIRVDAVDNVDADLLQIAGDYLKAAKGIHKNDKAANDHLSILEAWSYNDTPYLHDDGDNMINMDNRLRLSLLYSLAKPLNQRSGMNPLITNSLVNRTDDNAETAAVPSYSFIRAHDSEVQDLIRNIIRAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKATDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYAFPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFSLVSDNTFLPKSLVNPNHGTSSSVTGLVFDGKGYVYYSTSGYQAKNTFISLGNNWYYFDNNGYMVTGAQSINGANYYFLSNGIQLRNAIYDNGNKVLSYYGNDGRRYENGYYLFGQQWRYFQNGIMAVGLTRVHGAVQYFDASGFQAKGQFITTADGKLRYFDRDSGNQISNRFVRNSKGEWFLFDHNGVAVTGTVTFNGQRLYFKPNGVQAKGEFIRDADGHLRYYDPNSGNEVRNRFVRNSKGEWFLFDHNGIAVTGARVVNGQRLYFKSNGVQAKGELITERKGRIKYYDPNSGNEVRNRYVRTSSGNWYYFGNDGYALIGWHVVEGRRVYFDENGVYRYASHDQRNHWNYDYRRDFGRGSSSAIRFRHSRNGFFDNFFRF

SEQ ID NO: 13 - protein, 1646 aa, Lactobacillus animalis
MRSKKLWISLLFALTLIFTMAFSNMSAQAAGKDETSSSNETQTEQTLNTDESTDTTTDVSNEAKATEAQLTTQDADMASSEEKTTNVEKEVTTAETNKDTTVKNVESSEQNTTTVADKNAVDSTAQVNTAEKENKYTQENVNGNWYLKDEQGNYLTGFQEIKDQNKTVYYNPDSKQMVYGQQNINGNWYLFDTFNGAMQTGLQYIRDQKKLAYYNEQGQMQYGTVEIDGQKYQADTFNGAIKGKGQTKIADNWYLFNNAGQVVDGWQWINDQGKTVYYSTKTAQMVHGQQNINGHWYLFDKTTGAMQRGFQNLKAYGDDKTVYYNQDGWMLYGQQKIDNKWYNFDTFNGAMKTGFVKIPEQNKTVYYAPNGQMQYGWQWVDNATRYFDTFNGAMATGQKLITGHWYLFDNNGAMQRGFQNLKNYGDNKTVYYNQDGWMLYGWQWVNNATRYFDTFNGAMTTGQKKINDHWYLFDKDGAMQRGIQYIPEENKLVYYNQDGWMLYGKQNINGVDHNFNTFNGALEAKGQVKVGNNWYLFNNSGTIQTGFQDLKAYGQDKVVYYDPKTAAMVYGYQNIDGNWYLFSRANGSMQRGLQNVNGVDLLFDEKTGALLTGVQNIKGNNYFVDKRSGNIKKNLVVLGADNKWMYFDAKTGKGTNTLEDQYKKGVVSGNVEFITNNAAYSFDGNSFENINGFLTADSWYRPKSILKDGSTWTATTETDLRPLLMTWWPNEQIKANYLNYMKDKGFINNSGTYNAESDPNYMDFAAQEAQRNIERKITKENDTTWLRDLITDFIKTQDIWNEQSEGVSTEGLQKFQGGFLKYVNSELTPYANSEWRKLGYQPTMLTQNNVGAEFLLANDIDNSNPVVQAEQLNWLHFLMNFGTITANDPSANFDGIRIDAVDNVDASLLSIAGDYFKAAYKVGQNDATANKHISILEDWNDKDPEYVNSIGNPQLTMDDYIVQQLKFSLGQAPDKVDRMQRFKEWYLVDRSKDNTENTAIPNYSFVRAHDASVQEDILQLIQDTTGKPWGVYTNEELQQGLKDYMADQKLTNKKYNRYNIPSSYAILLTNKDTIPRVYYGDLYSDAGKYMAEKSIYFDAIDNLLKTRTKYVAGGQTLDVDGHDILTSVRFGKGALNVTDKGTSETRTQGMGLIISNNNSLKLNDGEKVVLHMGAAHKNQAYRAVMLSSANGLINYTSDANAPVVYTNNDGDLIFTNKDVVTNGKVQANTAIKGVMNPYVSGYLAMWVPVGASATQDARTAASTKTTTDGSVFHSNAALDSNLIYEGFSNFQAFPENASENANAIIAQNVDLFNSWGVTSFQLAPQYVSSHDGSFLDSIIDNGYAFTDRYDLAMSKNNKYGSYQDLVNVLKALHAGGIQVIADWVPDQIYSLPGKEVVSVVRSDEFGNKVDGTQIDNTLYVVNTIGGGQYQKEYGGRYLEELKQKYPELFKTKQPSTGVTIDPSEKITEWSAKYLNGTNILHRGAEFVLRDGATYFRVAETSEVFLPSQLRGKITKNGFWKNDAGKVNYYNSEGEIMKNAFVKDGKNNWYYFDNDGNMVTNTALTIDSDAQVADYYFLNNGISLRDGFVQLANGDIYYYDVNGRKLKNGKVTVNNVEYTTDKNGKVVGENVLKKLDEIITTGKTTLI

SEQ ID NO: 14 - protein, 1476 aa, Streptococcus mutans
MDKKVRYKLRKVKKRWVTVSVASAVMTLTTLSGGLVKADSNESKSQISNDSNTSVVTANEESNVTTEATSKQEAASSQTNHTVTTSSSSTSVVNPKEVVSNPYTVGETASNGEKLQNQTTTVDKTSEAAANNISKQTTEADTDVIDDSNAANIQILEKLPNVKEIDGKYYYYDNNGKVRTNFTLIADGKILHFDETGAYTDTSIDTVNKDIVTTRSNLYKKYNQVYDRSAQSFEHVDHYLTAESWYRPKYILKDGKTWTQSTEKDFRPLLMTWWPSQETQRQYVNFMNAQLGINKTYDDTSNQLQLNIAAATIQAKIEAKITTLKNTDWLRQTISAFVKTQSAWNSDSEKPFDDHLQNGAVLYDNEGKLTPYANSNYRILNRTPTNQTGKKDPRYTADNTIGGYEFLLANDVDNSNPVVQAEQLNWLHFLMNFGNIYANDPDANFDSIRVDAVDNVDADLLQIAGDYLKAAKGIHKNDKAANDHLSILEAWSDNDTPYLHDDGDNMINMDNKLRLSLLFSLAKPLNQRSGMNPLITNSLVNRTDDNAETAAVPSYSFIRAHDSEVQDLIRDIIKAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKAMDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYALPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFNISDNKEINFLPKTLLNQDSQVGFSYDGKGYVYYSTSGYQAKNTFISEGDKWYYFDNNGYMVTGAQSINGVNYYFLPNGLQLRDAILKNEDGTYAYYGNDGRRYENGYYQFMSGVWRHFNNGEMSVGLTVIDGQVQYFDEMGYQAKGKFVTTADGKIRYFDKQSGNMYRNRFIENEEGKWLYLGEDGAAVTGSQTINGQHLYFRANGVQVKGEFVTDRHGRISYYDGNSGDQIRNRFVRNAQGQWFYFDNNGYAVTGARTINGQHLYFRANGVQVKGEFVTDRHGRISYYDGNSGDQIRNRFVRNAQGQWFYFDNNGYAVTGARTINGQHLYFRANGVQVKGEFVTDRYGRISYYDGNSGDQIRNRFVRNAQGQWFYFDNNGYAVTGARTINGQHLYFRANGVQVKGEFVTDRYGRISYYDANSGERVRIN

SEQ ID NO: 15 - DNA, 3942 bp, Streptococcus mutans
atgattgacggcaaatactactactatgacaacaacggcaaagtacgcaccaatttcacgttgatcgcggacggtaaaatcctgcattttgatgaaactggcgcgtacaccgacactagcattgataccgtgaacaaggatattgtcacgacgcgtagcaacctgtataagaaatacaatcaagtgtatgatcgcagcgcgcagagcttcgagcatgttgatcactacctgacggcggaatcttggtaccgtccgaaatacattctgaaagatggcaagacctggacccagagcaccgagaaggacttccgtcctctgctgatgacctggtggccgagccaggaaacgcagcgccagtatgtcaacttcatgaacgcccagttgggtatcaacaaaacgtacgacgacaccagcaatcagctgcaattgaacatcgctgctgcaacgatccaagcaaagatcgaagccaaaatcacgacgctgaagaacaccgattggctgcgtcaaacgatcagcgcgttcgtcaaaacccaaagcgcttggaatagcgacagcgaaaagccgtttgatgaccatctgcaaaacggtgcggttctgtatgataacgaaggtaaattgacgccgtatgccaatagcaactatcgtattctgaaccgcacgccgaccaaccagaccggtaagaaggacccgcgttataccgccgacaacacgatcggcggctacgagtttctgctggccaacgacgtggataatagcaacccggtggttcaggccgagcagctgaactggctgcacttcctgatgaactttggtaatatctacgcaaacgaccctgacgctaacttcgactccatccgcgttgacgctgtcgataatgtggacgccgatctgttacagatcgcgggtgactatctgaaagcggcaaagggcatccataagaatgacaaagcggcgaacgaccacctgtccattctggaagcgtggagcgacaatgacactccgtatctgcatgatgatggcgacaacatgattaacatggataacaaactgcgcctgagcctgctgttctccctggcgaaaccgctgaatcagcgtagcggtatgaacccgttgattacgaacagcctggtcaaccgtactgatgataatgccgaaacggcggcagtgccaagctactcttttatccgtgcccacgatagcgaggtccaggatttgattcgtgatatcattaaggctgagattaacccgaacgtcgtcggttacagcttcacgatggaagagattaagaaggcatttgagatctacaataaggacctgttggccacggagaagaagtatacccactataacaccgcattgagctacgcgttgctgctgacgaacaagagcagcgtgccgcgtgtctactatggtgatatgtttacggacgatggtcaatacatggcccacaagaccattaactacgaggcaatcgaaaccctgctgaaagcacgtatcaagtacgtgtccggtggtcaggctatgcgcaaccagcaagtgggtaattcggagatcatcaccagcgtgcgttacggtaaaggtgcgctgaaggcgatggatacgggtgaccgcactacccgtacctctggtgtggcggtcattgagggcaacaacccgagcttgcgcctgaaggcttctgatcgtgtggttgtgaatatgggtgcggcccacaaaaatcaagcctatcgcccgctgctgttgacgaccgataacggcattaaggcctatcacagcgaccaagaagcggcaggcctggtgcgttacaccaacgaccgtggcgaactgatctttaccgcagccgacattaagggctacgcaaatccgcaagttagcggctacctgggcgtctgggtccctgttggcgcagcagctgatcaggacgttcgtgttgcggcgagcaccgcgccaagcacggacggcaagagcgttcaccagaacgcggctctggacagccgtgtgatgttcgagggtttctcgaacttccaggcatttgctaccaagaaagaagagtataccaatgtggtcatcgctaagaatgtggataagttcgcggagtggggtgtcaccgatttcgagatggctccgcaatacgtttctagcaccgacggtagctttttggatagcgtgattcaaaacggttatgcttttaccgaccgttacgacctgggcatcagcaagccgaacaaatatggcaccgcggacgatctggttaaagcgattaaggcattgcacagcaaaggcatcaaagttatggcggattgggttccggaccagatgtatgccctgccggaaaaagaggttgtgacggcaacccgtgttgacaaatacggtacgccggtagctggcagccagatcaaaaacacgctgtacgtggtcgatggtaaatctagcggtaaggaccagcaggcgaagtacggtggtgccttcctggaagagctgcaagcgaagtatccggaactgttcgcgcgcaaacagattagcaccggtgttccgatggacccgagcgtcaagattaagcaatggagcgcaaaatacttcaacggcacgaatatcctgggtcgtggtgctggttacgtgctgaaagatcaggcaaccaacacctactttaacatcagcgacaataaagagatcaatttcctgccaaagacgttgctgaaccaggattctcaagttggctttagctacgacggtaagggctatgtgtactacagcacctcgggctaccaggctaaaaacacgttcatcagcgagggtgacaagtggtattacttcgacaataacggttatatggttaccggcgcacagagcattaatggtgtgaactattacttcctgccgaatggtttacagctgcgtgatgcgattctgaaaaatgaggacggtacgtacgcgtattatggcaatgatggtcgccgctacgagaatggctattatcagtttatgagcggtgtttggcgccatttcaataatggcgagatgtccgttggtctgaccgtcattgacggtcaagttcaatactttgacgagatgggttaccaggcgaaaggcaaattcgttaccaccgcggatggtaagatccgttacttcgataagcagagcggcaatatgtatcgtaatcgtttcattgagaacgaagagggcaaatggctgtacctgggtgaggacggcgcggcagtcaccggtagccagacgatcaatggtcagcacctgtattttcgtgctaacggcgttcaggttaagggtgagttcgtgaccgatcgtcatggccgcatctcttattacgacggcaacagcggtgatcagatccgcaaccgtttcgtccgcaatgcgcaaggccagtggttttactttgacaacaatggctatgcagtaactggtgctcgtacgatcaacggccagcacctgtatttccgcgcgaacggtgttcaggtaaaaggtgagtttgttacggaccgccacggccgcattagctattatgatggtaatagcggtgaccaaattcgcaatcgtttcgtgcgtaatgcacagggtcagtggttctacttcgacaataatggttatgcagtcacgggtgcacgtaccattaacggccaacacctgtactttcgcgccaatggtgtgcaagtgaaaggcgaatttgttactgatcgttatggtcgtatcagctactatgatggcaattctggcgaccaaattcgcaatcgctttgttcgtaacgcccaaggtcaatggttctatttcgacaacaacggttacgcggtgaccggtgcccgcacgattaatggtcaacacttgtacttccgtgccaacggtgtccaggtgaagggtgaatttgtgaccgaccgctatggtcgcatttcttactacgacgcaaattccggtgaacgcgtccgtatcaattaa

SEQ ID NO: 16 - protein, 1313 aa, Streptococcus mutans
MIDGKYYYYDNNGKVRTNFTLIADGKILHFDETGAYTDTSIDTVNKDIVTTRSNLYKKYNQVYDRSAQSFEHVDHYLTAESWYRPKYILKDGKTWTQSTEKDFRPLLMTWWPSQETQRQYVNFMNAQLGINKTYDDTSNQLQLNIAAATIQAKIEAKITTLKNTDWLRQTISAFVKTQSAWNSDSEKPFDDHLQNGAVLYDNEGKLTPYANSNYRILNRTPTNQTGKKDPRYTADNTIGGYEFLLANDVDNSNPVVQAEQLNWLHFLMNFGNIYANDPDANFDSIRVDAVDNVDADLLQIAGDYLKAAKGIHKNDKAANDHLSILEAWSDNDTPYLHDDGDNMINMDNKLRLSLLFSLAKPLNQRSGMNPLITNSLVNRTDDNAETAAVPSYSFIRAHDSEVQDLIRDIIKAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKAMDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYALPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFNISDNKEINFLPKTLLNQDSQVGFSYDGKGYVYYSTSGYQAKNTFISEGDKWYYFDNNGYMVTGAQSINGVNYYFLPNGLQLRDAILKNEDGTYAYYGNDGRRYENGYYQFMSGVWRHFNNGEMSVGLTVIDGQVQYFDEMGYQAKGKFVTTADGKIRYFDKQSGNMYRNRFIENEEGKWLYLGEDGAAVTGSQTINGQHLYFRANGVQVKGEFVTDRHGRISYYDGNSGDQIRNRFVRNAQGQWFYFDNNGYAVTGARTINGQHLYFRANGVQVKGEFVTDRHGRISYYDGNSGDQIRNRFVRNAQGQWFYFDNNGYAVTGARTINGQHLYFRANGVQVKGEFVTDRYGRISYYDGNSGDQIRNRFVRNAQGQWFYFDNNGYAVTGARTINGQHLYFRANGVQVKGEFVTDRYGRISYYDANSGERVRIN

SEQ ID NO: 17 - protein, 1518 aa, Streptococcus salivarius
MENKIHYKLHKVKKQWVTIAVASVALATVLGGLSVTTSSVSADETQDKTVTQSNSGTTASLVTSPEATKEADKRTNTKEADVLTPAKETNAVETATTTNTQATAEAATTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 18 - DNA, 4434 bp, Streptococcus salivarius
atggacgaaacgcaggataagaccgtgacgcagagcaacagcggcaccaccgcttccctggtcactagccctgaagccacgaaagaggcggacaaacgcacgaacactaaagaggccgacgttctgacgcctgcaaaagaaacgaacgcagtcgagactgcgaccaccactaacacccaggcgacggcggaggccgccacgaccgcgaccaccgcggacgtcgcggtggctgcggtgccgaacaaagaagcggtcgttaccacggatgctccggcggtcacgaccgagaaagcggaagaacagccggctaccgttaaagcagaagtcgtcaatacggaagtgaaagcgccggaagcggctctgaaagacagcgaggttgaggcagcgctgagcctgaagaacatcaagaacattgatggcaagtattactatgttaatgaggatggcagccacaaagagaatttcgctattaccgtgaatggccagctgctgtactttggtaaagacggtgcgctgacgtcctctagcacgtattcttttaccccaggcactaccaatatcgtggacggttttagcattaacaaccgcgcttacgacagcagcgaggcgagctttgagctgatcgacggttacttgaccgcagacagctggtatcgtccggctagcatcatcaaagatggtgttacgtggcaagcgtccaccgccgaggattttcgtccgctgctgatggcatggtggccgaatgtggatacgcaggtgaactatttgaattacatgtccaaagttttcaacctggacgcgaaatactctagcaccgacaaacaggaaaccctgaaagtggcagcaaaagacattcaaatcaagattgaacaaaagattcaagcggagaagagcacgcagtggctgcgtgaaactatcagcgcctttgtgaaaacccagccgcagtggaacaaagaaaccgagaattacagcaagggtggtggtgaggaccacctgcaaggtggcgcactgctgtatgttaacgacagccgtaccccttgggcgaatagcgattaccgtcgtctgaatcgcaccgcaaccaatcagacgggcacgatcgataagtctattctggacgagcagtctgacccaaaccacatgggcggtttcgactttctgctggcgaacgacgtcgacctgagcaatccggtcgtgcaggctgagcagctgaatcaaatccactatctgatgaattggggttccattgtgatgggtgacaaggatgcgaactttgacggcattcgtgtcgatgcagttgacaacgtggacgcggacatgttgcaactgtataccaattacttccgtgagtactacggtgtgaacaagagcgaagctaacgcactggctcacatcagcgttctggaggcgtggagcctgaatgataatcattacaatgacaagaccgatggtgcggcactggcaatggagaataagcaacgtctggcgctgttgttttcgttggcgaaaccgatcaaagagcgtaccccggcagtgagcccgctgtataacaacaccttcaataccacccagcgtgatgaaaagaccgattggattaacaaagacggtagcaaggcttacaacgaagatggcacggtcaaacaatcgaccatcggtaagtacaacgagaaatacggtgacgcatccggtaactacgttttcatccgtgcccacgataacaacgtccaggacatcatcgccgagatcatcaagaaagagatcaacccgaaaagcgacggcttcaccatcaccgacgccgaaatgaagcaagcctttgaaatctataacaaagatatgctgtcgagcgacaaaaagtataccctgaataacattccggcagcgtatgccgtgatgttgcagaatatggaaacgattacccgcgtctattacggtgatctgtatacggacgacggtcactacatggaaaccaaatctccgtattacgataccatcgtgaatttgatgaagagccgtatcaagtatgtttcgggtggccaggcgcaacgtagctattggctgccgaccgacggtaagatggacaatagcgacgttgagctgtaccgcacgaatgaggtttacacgagcgtgcgctatggtaaggatatcatgaccgctaatgataccgaaggctctaagtattcccgcaccagcggccaagtcaccttggtcgcgaacaatccgaagctgaatctggaccaaagcgccaagttgaatgtggagatgggcaaaatccatgcgaatcagaagtatcgcgcactgattgtcggcactgcggacggcattaagaactttacttccgacgcggacgccattgcagcgggttatgtgaaagaaaccgatagcaacggcgtgctgaccttcggtgctaacgacattaagggctacgaaacgtttgatatgagcggtttcgtggcggtgtgggttccggtgggtgcatctgacaatcaggacattcgtgttgcgccgagcaccgaggcaaagaaagaaggtgagctgaccttgaaggcgacggaagcgtatgatagccagctgatttacgaaggctttagcaatttccagacgatcccagatggcagcgatccgtccgtgtatacgaaccgcaagattgcggagaacgtggatctgttcaaaagctggggtgtcaccagctttgagatggcaccgcaatttgtctcggcggatgatggcacctttctggatagcgttattcagaatggctacgccttcgccgaccgttatgacctggccatgtccaagaacaacaagtatggtagcaaagaggacctgcgtgatgcactgaaagcactgcataaggcgggtattcaagctatcgcagactgggttccagaccagatctaccagctgccgggcaaagaagttgtcaccgccacccgtacggatggtgctggccgtaagatcgcagacgcgattatcgaccattctctgtatgttgcaaacagcaaaagcagcggcaaagattatcaagcaaagtacggtggcgagttcctggccgagctgaaagccaaatacccggaaatgttcaaagttaacatgattagcacgggtaagccgattgatgactccgtgaaattgaagcaatggaaagccgagtacttcaatggcaccaacgttttggaacgtggtgtcggctatgttctgagcgacgaggcgaccggtaagtatttcacggtgaccaaagaaggcaatttcattccgctgcaactgacgggtaaagagaaagttatcacgggtttctccagcgatggtaagggtatcacctatttcggtacgagcggtacgcaggcgaagtctgcgtttgttaccttcaatggtaacacctactatttcgacgcgcgtggccacatggttaccaatagcgaatacagcccgaatggcaaggacgtctaccgttttctgccgaacggtatcatgctgagcaatgcgttttacattgatgcgaacggtaatacctacctgtacaactctaagggtcaaatgtacaaaggcggttacacgaaattcgatgtttctgaaacggataaggacggtaaagagtccaaggtcgtcaagttccgctactttacgaacgaaggcgtcatggccaagggtgttaccgtcattgatggttttacccaatacttcggtgaggacggctttcaagcgaaggataagctggtcaccttcaagggcaagacgtattacttcgacgcacacactggtaatggtatcaaagatacctggcgcaatatcaatggtaaatggtactatttcgacgcgaatggcgttgctgcgaccggtgcgcaggtgattaacggccagaaactgtacttcaacgaggatggctcccaagtcaaaggcggcgtggttaagaacgcagacggcacctatagcaaatacaaagaaggttttggtgagctggttactaacgagtttttcacgactgatggcaatgtttggtactacgccggtgcaaatggtaaaaccgttaccggtgcacaagtgatcaacggccaacatttgtacttcaatgcggacggttcccaggtgaagggtggcgttgtcaagaacgcggatggcacctacagcaagtacaatgctagcactggtgaacgtctgacgaacgagttctttacgaccggtgataacaattggtattacattggcgcaaacggtaagagcgtgacgggtgaggtcaagattggtgatgatacttactttttcgcgaaggatggcaaacaagttaaaggtcaaaccgtcagcgccggtaatggtcgcattagctactactacggtgacagcggcaagcgtgcggttagcacctggattgagattcagccgggtgtttatgtgtatttcgacaaaaacggtttggcgtaccctccgcgtgttctgaattaa

SEQ ID NO: 19 - protein, 1477 aa, Streptococcus salivarius
MDETQDKTVTQSNSGTTASLVTSPEATKEADKRTNTKEADVLTPAKETNAVETATTTNTQATAEAATTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 20 - DNA, 3351 bp, Paenibacillus humicus
atggctagcgcagcaggaggcgcgaatctgacgctcggcaaaaccgtcaccgccagcggccagtcgcagacgtacagccccgacaatgtcaaggacagcaatcagggaacttactgggaaagcacgaacaacgccttcccgcagtggatccaagtcgaccttggcgccagcacgagcatcgaccagatcgtgctcaaacttccgtccggatgggagactcgtacgcaaacgctctcgatacagggcagcgcgaacggctcgacgttcacgaacatcgtcggatcggccgggtatacattcaatccatccgtcgccggcaacagcgtcacgatcaacttcagcgctgccagcgcccgctacgtccgcctgaatttcacggccaatacgggctggccagcaggccagctgtcggagcttgagatctacggagcgacggcgccaacgcctactcccacgcctactccaacaccaacgccaacgccaacaccaacgccaacccctacagtaacccctgcgccttcggccacgccgactccgactcctccggcaggcagcaacatcgccgtagggaaatcgattacagcctcttccagcacgcagacctacgtagctgcaaatgcaaatgacaacaatacatccacctattgggagggaggaagcaacccgagcacgctgactctcgatttcggttccaaccagagcatcacttccgtcgtcctcaagctgaatccggcttcggaatgggggactcgcacgcaaacgatccaagttcttggagcggatcagaacgccggctccttcagcaatctcgtctctgcccagtcctatacgttcaatcccgcaaccggcaatacggtgacgattccggtctccgcgacggtcaagcgcctccagctgaacattacggcgaactccggcgcccctgccggccagattgccgagttccaagtgttcggcacgccagcgcctaatccggacttgaccattaccggcatgtcctggactccgtcttctccggtcgagagcggcgacattacgctgaacgccgtcgtcaagaacatcggaactgcagctgcaggcgccacgacggtcaatttctacctgaacaacgaactcgccggcaccgctccggtaggcgcgcttgcggcaggagcttctgcaaatgtatcgatcaatgcaggcgccaaagcagccgcaacgtatgcggtaagcgccaaagtcgacgagagcaacgccgtcatcgagcagaatgaaggcaacaacagctactcgaacccgactaacctcgtcgtagcgccggtgtccagctccgacctcgtcgccgtgacgtcatggtcgccgggcacgccgtcgcagggagcggcggtcgcatttaccgtcgcgcttaaaaatcagggtacgctggcttccgccggcggagcccatcccgtaaccgtcgttctgaaaaacgctgccggagcgacgctgcaaaccttcacgggcacctacacaggttccctggcagcaggcgcatccgcgaatatcagcgtgggcagctggacggcagcgagcggcacctataccgtctcgacgacggtagccgctgacggcaatgaaattccggccaagcaaagcaacaatacgagcagcgcgagcctcacggtctactcggcgcgcggcgccagcatgccgtacagccgttacgacacggaggatgcggtgctcggcggcggagctgtcctgagaacggcgccgacgttcgatcagtcgctcatcgcttccgaagcatcgggacagaaatacgccgcacttccgtccaacggctccagcctgcagtggaccgtccgtcaaggccagggcggtgcaggcgtcacgatgcgcttcacgatgcccgacacgagcgacggcatgggccagaacggctcgctcgacgtctatgtcaacggaaccaaagccaaaacggtgtcgctgacctcttattacagctggcagtatttctccggcgacatgccggctgacgctccgggcggcggcaggccgctcttccgcttcgacgaagtccacttcaagctggatacggcgttgaagccgggagacacgatccgcgtccagaagggcggtgacagcctggagtacggcgtcgacttcatcgagatcgagccgattccggcagcggttgcccgtccggccaactcggtgtccgtcaccgaatacggcgctgtcgccaatgacggcaaggatgatctcgccgccttcaaggctgccgtgaccgcagcggtagcggccggaaaatccctctacatcccggaaggcaccttccacctgagcagcatgtgggagatcggctcggccaccagcatgatcgacaacttcacggtcacgggtgccggcatctggtatacgaacatccagttcacgaatcccaatgcatcgggcggcggcatctccctgagaatcaaaggaaagctggatttcagcaacatctacatgaactccaacctgcgttcccgttacgggcagaacgccgtctacaaaggctttatggacaatttcggcactaattcgatcatccatgacgtctgggtcgagcatttcgaatgcggcatgtgggtcggcgactacgcccatactcctgcgatctatgcgagcgggctcgtcgtggaaaacagccgcatccgcaacaatcttgccgacggcatcaacttctcgcagggaacgagcaactcgaccgtccgcaacagcagcatccgcaacaacggcgatgacggcctcgccgtctggacgagcaacacgaacggcgctccggccggcgtgaacaacaccttctcctacaacacgatcgagaacaactggcgcgcggcggccatcgccttcttcggcggcagcggccacaaggctgaccacaactacatcatcgactgtgtcggcggctccggcatccggatgaatacggtgttcccaggctaccacttccagaacaacaccggcatcaccttctcggatacgacgatcatcaacagcggcaccagccaggatctgtacaacggcgagcgcggagcgattgatctggaagcatccaacgacgcgatcaaaaacgtcaccttcaccaacatcgacatcatcaatgcccagcgcgacggcgttcagatcggctatggcggcggcttcgagaacatcgtgttcaacaacatcacgatcgacggcaccggccgcgacgggatatcgacatcccgcttctcgggacctcatcttggcgcagccatctatacgtacacgggcaacggctcggcgacgttcaacaacctggtgacccggaacatcgcctatgcaggcggcaactacatccagagcgggttcaacctgacgatctaa

SEQ ID NO: 21 - protein, 1116 aa, Paenibacillus humicus
MASAAGGANLTLGKTVTASGQSQTYSPDNVKDSNQGTYWESTNNAFPQWIQVDLGASTSIDQIVLKLPSGWETRTQTLSIQGSANGSTFTNIVGSAGYTFNPSVAGNSVTINFSAASARYVRLNFTANTGWPAGQLSELEIYGATAPTPTPTPTPTPTPTPTPTPTPTVTPAPSATPTPTPPAGSNIAVGKSITASSSTQTYVAANANDNNTSTYWEGGSNPSTLTLDFGSNQSITSVVLKLNPASEWGTRTQTIQVLGADQNAGSFSNLVSAQSYTFNPATGNTVTIPVSATVKRLQLNITANSGAPAGQIAEFQVFGTPAPNPDLTITGMSWTPSSPVESGDITLNAVVKNIGTAAAGATTVNFYLNNELAGTAPVGALAAGASANVSINAGAKAAATYAVSAKVDESNAVIEQNEGNNSYSNPTNLVVAPVSSSDLVAVTSWSPGTPSQGAAVAFTVALKNQGTLASAGGAHPVTVVLKNAAGATLQTFTGTYTGSLAAGASANISVGSWTAASGTYTVSTTVAADGNEIPAKQSNNTSSASLTVYSARGASMPYSRYDTEDAVLGGGAVLRTAPTFDQSLIASEASGQKYAALPSNGSSLQWTVRQGQGGAGVTMRFTMPDTSDGMGQNGSLDVYVNGTKAKTVSLTSYYSWQYFSGDMPADAPGGGRPLFRFDEVHFKLDTALKPGDTIRVQKGGDSLEYGVDFIEIEPIPAAVARPANSVSVTEYGAVANDGKDDLAAFKAAVTAAVAAGKSLYIPEGTFHLSSMWEIGSATSMIDNFTVTGAGIWYTNIQFTNPNASGGGISLRIKGKLDFSNIYMNSNLRSRYGQNAVYKGFMDNFGTNSIIHDVWVEHFECGMWVGDYAHTPAIYASGLVVENSRIRNNLADGINFSQGTSNSTVRNSSIRNNGDDGLAVWTSNTNGAPAGVNNTFSYNTIENNWRAAAIAFFGGSGHKADHNYIIDCVGGSGIRMNTVFPGYHFQNNTGITFSDTTIINSGTSQDLYNGERGAIDLEASNDAIKNVTFTNIDIINAQRDGVQIGYGGGFENIVFNNITIDGTGRDGISTSRFSGPHLGAAIYTYTGNGSATFNNLVTRNIAYAGGNYIQSGFNLTI

SEQ ID NO: 22 - DNA, 1308 bp, Penicillium marneffei
atgaagcaaaccacttccctcctcctctcagccatcgcggcaaccagcagcttcagcggactaacagccgctcaaaaactcgcctttgcgcacgtcgtcgtcggcaacactgcagcacacacccaatccacctgggaaagcgacattactctcgcccataactccggtctagatgcctttgccttgaacggtggattccccgatggcaacatccccgcacaaatcgccaacgcttttgcggcttgtgaagccctttcaaatggcttcaagctattcatttcgtttgactacctcggtggtggtcagccctggcctgcctcagaggttgtgtctatgctgaagcagtatgccagttccgattgttatttggcctatgatggcaagccctttgtctcaacttttgagggcaccggaaatattgcggattgggcgcacggaggtcccattcggtcggcggtggatgtttactttgtgccggattggacgagtttggggcctgctgggattaagtcgtatctcgacaatatcgatggatttttcagctggaacatgtggcctgtaggtgcggccgatatgaccgacgagcctgatttcgaatggctcgatgcaattgggtccgacaagacgtacatgatgggcgtttcgccatggttcttccacagtgcaagcggaggcaccgactgggtctggcgtggtgatgacctctgggatgaccgatggattcaagtcacctgcgtcgaccctcaatttgtccaggtcgtcacatggaacgactggggtgaatcctcctacatcggccccttcgtgaccgctagcgaagtccccgccggctcattagcctacgtcgacaacatgtcacaccaaagcttccttgacttcttgcctttctacatcgccaccttcaaaggcgacacattcaacatctcccgcgaccagatgcaatactggtaccgcctcgcacccgccgcagcaggcagcgcgtgcggcgtatacggcaatgatcccgatcaaggccagactaccgttgacgtcaactccatcgttcaggacaaggtgtttttcagtgctttgttgacggctgatgctactgtaacggtgcagattggtagtaatgctgcggtttcatatgatggtgttgctggtatgaaccactggagtcaggactttaatggccagaccggcgcggttacgtttagtgttgtcaggggtggcgctacagttaagagtggtattggagccgagattacggcttcgacttcgttgtcgaatgggtgcactaattacaacccttgggttggtagtttctaa

SEQ ID NO: 23 - protein, 435 aa, Penicillium marneffei
MKQTTSLLLSAIAATSSFSGLTAAQKLAFAHVVVGNTAAHTQSTWESDITLAHNSGLDAFALNGGFPDGNIPAQIANAFAACEALSNGFKLFISFDYLGGGQPWPASEVVSMLKQYASSDCYLAYDGKPFVSTFEGTGNIADWAHGGPIRSAVDVYFVPDWTSLGPAGIKSYLDNIDGFFSWNMWPVGAADMTDEPDFEWLDAIGSDKTYMMGVSPWFFHSASGGTDWVWRGDDLWDDRWIQVTCVDPQFVQVVTWNDWGESSYIGPFVTASEVPAGSLAYVDNMSHQSFLDFLPFYIATFKGDTFNISRDQMQYWYRLAPAAAGSACGVYGNDPDQGQTTVDVNSIVQDKVFFSALLTADATVTVQIGSNAAVSYDGVAGMNHWSQDFNGQTGAVTFSVVRGGATVKSGIGAEITASTSLSNGCTNYNPWVGSF

SEQ ID NO: 24 - DNA, 8616 bp, artificial sequence
  plasmid pTrex
aagcttaactagtacttctcgagctctgtacatgtccggtcgcgacgtacgcgtatcgatggcgccagctgcaggcggccgcctgcagccacttgcagtcccgtggaattctcacggtgaatgtaggccttttgtagggtaggaattgtcactcaagcacccccaacctccattacgcctcccccatagagttcccaatcagtgagtcatggcactgttctcaaatagattggggagaagttgacttccgcccagagctgaaggtcgcacaaccgcatgatatagggtcggcaacggcaaaaaagcacgtggctcaccgaaaagcaagatgtttgcgatctaacatccaggaacctggatacatccatcatcacgcacgaccactttgatctgctggtaaactcgtattcgccctaaaccgaagtgcgtggtaaatctacacgtgggcccctttcggtatactgcgtgtgtcttctctaggtgccattcttttcccttcctctagtgttgaattgtttgtgttggagtccgagctgtaactacctctgaatctctggagaatggtggactaacgactaccgtgcacctgcatcatgtatataatagtgatcctgagaaggggggtttggagcaatgtgggactttgatggtcatcaaacaaagaacgaagacgcctcttttgcaaagttttgtttcggctacggtgaagaactggatacttgttgtgtcttctgtgtatttttgtggcaacaagaggccagagacaatctattcaaacaccaagcttgctcttttgagctacaagaacctgtggggtatatatctagagttgtgaagtcggtaatcccgctgtatagtaatacgagtcgcatctaaatactccgaagctgctgcgaacccggagaatcgagatgtgctggaaagcttctagcgagcggctaaattagcatgaaaggctatgagaaattctggagacggcttgttgaatcatggcgttccattcttcgacaagcaaagcgttccgtcgcagtagcaggcactcattcccgaaaaaactcggagattcctaagtagcgatggaaccggaataatataataggcaatacattgagttgcctcgacggttgcaatgcaggggtactgagcttggacataactgttccgtaccccacctcttctcaacctttggcgtttccctgattcagcgtacccgtacaagtcgtaatcactattaacccagactgaccggacgtgttttgcccttcatttggagaaataatgtcattgcgatgtgtaatttgcctgcttgaccgactggggctgttcgaagcccgaatgtaggattgttatccgaactctgctcgtagaggcatgttgtgaatctgtgtcgggcaggacacgcctcgaaggttcacggcaagggaaaccaccgatagcagtgtctagtagcaacctgtaaagccgcaatgcagcatcactggaaaatacaaaccaatggctaaaagtacataagttaatgcctaaagaagtcatataccagcggctaataattgtacaatcaagtggctaaacgtaccgtaatttgccaacggcttgtggggttgcagaagcaacggcaaagccccacttccccacgtttgtttcttcactcagtccaatctcagctggtgatcccccaattgggtcgcttgtttgttccggtgaagtgaaagaagacagaggtaagaatgtctgactcggagcgttttgcatacaaccaagggcagtgatggaagacagtgaaatgttgacattcaaggagtatttagccagggatgcttgagtgtatcgtgtaaggaggtttgtctgccgatacgacgaatactgtatagtcacttctgatgaagtggtccatattgaaatgtaagtcggcactgaacaggcaaaagattgagttgaaactgcctaagatctcgggccctcgggccttcggcctttgggtgtacatgtttgtgctccgggcaaatgcaaagtgtggtaggatcgaacacactgctgcctttaccaagcagctgagggtatgtgataggcaaatgttcaggggccactgcatggtttcgaatagaaagagaagcttagccaagaacaatagccgataaagatagcctcattaaacggaatgagctagtaggcaaagtcagcgaatgtgtatatataaaggttcgaggtccgtgcctccctcatgctctccccatctactcatcaactcagatcctccaggagacttgtacaccatcttttgaggcacagaaacccaatagtcaaccgcggactgcgcatcatgtatcggaagttggccgtcatctcggccttcttggccacacctcgtgctagactaggcgcgccgcgcgccagctccgtgcgaaagcctgacgcaccggtagattcttggtgagcccgtatcatgacggcggcgggagctacatggccccgggtgatttattttttttgtatctacttctgacccttttcaaatatacggtcaactcatctttcactggagatgcggcctgcttggtattgcgatgttgtcagcttggcaaattgtggctttcgaaaacacaaaacgattccttagtagccatgcattttaagataacggaatagaagaaagaggaaattaaaaaaaaaaaaaaaacaaacatcccgttcataacccgtagaatcgccgctcttcgtgtatcccagtaccagtttattttgaatagctcgcccgctggagagcatcctgaatgcaagtaacaaccgtagaggctgacacggcaggtgttgctagggagcgtcgtgttctacaaggccagacgtcttcgcggttgatatatatgtatgtttgactgcaggctgctcagcgacgacagtcaagttcgccctcgctgcttgtgcaataatcgcagtggggaagccacaccgtgactcccatctttcagtaaagctctgttggtgtttatcagcaatacacgtaatttaaactcgttagcatggggctgatagcttaattaccgtttaccagtgccatggttctgcagctttccttggcccgtaaaattcggcgaagccagccaatcaccagctaggcaccagctaaaccctataattagtctcttatcaacaccatccgctcccccgggatcaatgaggagaatgagggggatgcggggctaaagaagcctacataaccctcatgccaactcccagtttacactcgtcgagccaacatcctgactataagctaacacagaatgcctcaatcctgggaagaactggccgctgataagcgcgcccgcctcgcaaaaaccatccctgatgaatggaaagtccagacgctgcctgcggaagacagcgttattgatttcccaaagaaatcggggatcctttcagaggccgaactgaagatcacagaggcctccgctgcagatcttgtgtccaagctggcggccggagagttgacctcggtggaagttacgctagcattctgtaaacgggcagcaatcgcccagcagttagtagggtcccctctacctctcagggagatgtaacaacgccaccttatgggactatcaagctgacgctggcttctgtgcagacaaactgcgcccacgagttcttccctgacgccgctctcgcgcaggcaagggaactcgatgaatactacgcaaagcacaagagacccgttggtccactccatggcctccccatctctctcaaagaccagcttcgagtcaaggtacaccgttgcccctaagtcgttagatgtccctttttgtcagctaacatatgccaccagggctacgaaacatcaatgggctacatctcatggctaaacaagtacgacgaaggggactcggttctgacaaccatgctccgcaaagccggtgccgtcttctacgtcaagacctctgtcccgcagaccctgatggtctgcgagacagtcaacaacatcatcgggcgcaccgtcaacccacgcaacaagaactggtcgtgcggcggcagttctggtggtgagggtgcgatcgttgggattcgtggtggcgtcatcggtgtaggaacggatatcggtggctcgattcgagtgccggccgcgttcaacttcctgtacggtctaaggccgagtcatgggcggctgccgtatgcaaagatggcgaacagcatggagggtcaggagacggtgcacagcgttgtcgggccgattacgcactctgttgagggtgagtccttcgcctcttccttcttttcctgctctataccaggcctccactgtcctcctttcttgctttttatactatatacgagaccggcagtcactgatgaagtatgttagacctccgcctcttcaccaaatccgtcctcggtcaggagccatggaaatacgactccaaggtcatccccatgccctggcgccagtccgagtcggacattattgcctccaagatcaagaacggcgggctcaatatcggctactacaacttcgacggcaatgtccttccacaccctcctatcctgcgcggcgtggaaaccaccgtcgccgcactcgccaaagccggtcacaccgtgaccccgtggacgccatacaagcacgatttcggccacgatctcatctcccatatctacgcggctgacggcagcgccgacgtaatgcgcgatatcagtgcatccggcgagccggcgattccaaatatcaaagacctactgaacccgaacatcaaagctgttaacatgaacgagctctgggacacgcatctccagaagtggaattaccagatggagtaccttgagaaatggcgggaggctgaagaaaaggccgggaaggaactggacgccatcatcgcgccgattacgcctaccgctgcggtacggcatgaccagttccggtactatgggtatgcctctgtgatcaacctgctggatttcacgagcgtggttgttccggttacctttgcggataagaacatcgataagaagaatgagagtttcaaggcggttagtgagcttgatgccctcgtgcaggaagagtatgatccggaggcgtaccatggggcaccggttgcagtgcaggttatcggacggagactcagtgaagagaggacgttggcgattgcagaggaagtggggaagttgctgggaaatgtggtgactccatagctaataagtgtcagatagcaatttgcacaagaaatcaataccagcaactgtaaataagcgctgaagtgaccatgccatgctacgaaagagcagaaaaaaacctgccgtagaaccgaagagatatgacacgcttccatctctcaaaggaagaatcccttcagggttgcgtttccagtctagacacgtataacggcacaagtgtctctcaccaaatgggttatatctcaaatgtgatctaaggatggaaagcccagaatatcgatcgcgcgcagatccatatatagggcccgggttataattacctcaggtcgacgtcccatggccattcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaaattgtaaacgttaatattttgttaaaattcgcgttaaatttttgttaaatcagctcattttttaaccaataggccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtactatggttgctttgacgtatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgc

SEQ ID NO: 25 - DNA, 3855 bp, Gluconobacter oxydans
atggctgacaactctgacgagcaattcgtagcgtccgattacacgctgcttggtgacgcgaccgacgaccccaacggtatggtcgacatgccggccggtcaggagccagccacgaccaacgcggttccgtcgggcgtcgaatacaatttcctcgccgcgacagcggggtattacacggtcagctttgcctatcagaatacggcgaacgcggctgcttacgaacagctttccatcaatggccagaacgagcccggggtcgtcgaattcgaccagaccagcggcgcctcgacgggcacggcctatgcgtcagtctatctgaaggcaggcctgaattcggtcgaactgaataatcagacgaccgatgagaccaatggcctgacaccggtgccggaggatcagcttcaggcaagccccgccttccagatcggcacgtccacggtcgcggccggcgcatcgccctcccaggaaacgtcggcgcagtcgctcgcgatctccaatcagacggatatgcaggcgttcgttcaaggcgagagcatggcgcctaagcagcaatggacattcggcccgagcctgtccgaactgcatgtcggcagcaacgacgaactcaatcagctcgacttcaacgccgtctggttccgcaacgtcacgcccggccagcaggccgagacttattcgccgtatttcaaatccaacgagtcgttcgatgccaacggcgtcctgcatgtgaactatggtgcctactcgccgaccggccaggcgctgccggtgcagatccaggcaacctatgccaacgttccgaacgaaaacctcatcgtcgaaaacctgtccctgaccaatcagaatgcgagcggcacccagccgctggtctgggacgtgatgaatgccaccggtatcaacccaggtgaagtcagcagcacgacatgggatccgacgcataacgcatggatcgttaccgaggaccagggaagtggcaaatccccgctttatctagcgatcggtgactatcaggtcagcaacagcacgcacgcggcaggcgtcgacggcgtcaatgtgcgcggcagctattccctgtcgagcggcgcgtccggcaatccgtccctgaatgctccggaccagggcgttatcggcgggttcgagaacaacggcacgatggtcggcagcagttcgggcgcgtcgggcacaaatctcgcggtcggcaccaccgacagcgatgtcaccctgaatcccggccagaccgtcgacctcagctactatctctcgacagccaccagcctgtcgcagctcgacgccaatctcgataaatatacgaacacagtcgggtccacgacgtcgtcgacgccgatgacggacgccaccggcgcttccgccgcgagttcctggactcagcagacggctaccgcatgggacgacacgctcaaccaggcctacaatttggctgggtcgacagaaacaagcggacaggctgcaactgccgccagcgggcagacactggatcctacaagcagcgctgcggcccagagtgcctatcgctccagtctgatcaatattttgcaggcacagagcccggaatacggctcgttcatggcgtccaccaacccgtcctatgaatacaaggtctgggtgcgcgacagcgccgcaaccgcgatcggtctggacgacgcaggcctgacccaaccggccgacaagttctggcgctggatggcgtccgtcgagcagaacggcatgaatgcgacctatagcggcaacgcttcaggcacattctcgacgaactatggagaattcgaccagaacctgccgatcgggttcgtcgcgccggaaaacgactctcagggcctgttcctcatcgggtcttaccgtcattacgagcagatgctcagcgagggccagactcagcaggcccagtccttcatcagcgatccgacggtgcgtcaggctctggtcaactccgcgaactggatccaggaaaatattggtagcaacgggcttgggccggctgactactcaatctgggaggacatgtacggctatcatactttcacgcaggtcacctacgcggaagggctgaacgcagcatcgcaactcgcctcggccatgggcgagggcaatcaggcccagacctgggcgaccggcgccgagacgatcaaggatgcgatcctgcgtccgaccacggcgtcgacgccggggctctggaatgcgcaggaaggtcatttcgtcgaaatgatcaaccagaacggaacgattgacaatacgatcgacgccgataccaacattgccgccgtcttcggtcttgtctcgcccacaagcatctatgcgactgaaaacgcgcaggctgtcgaaaatgcgctgacgcaggacaatttcggtctatcgcgctatcagaacgaaacattctaccagtcctcgcagtggagccctgggggcacatacgaggcgcaaggcatctcgccgtcctggccgcagatgaccgcctatgacagcatcgtcagcatggattccggcaatacgacccaggcaaataacgaccttagctggatcgaacagtcctatgacaatggcggcactccgcccggtgaatcctacgactgggcgcgtggccagccgatcgaaagcacatcgtccgaaccggtgacggcgagctggtacgtccaggatctcctgaacagcaccggccagacatcgaccctgatgcctgcgattaccgggcaggcaccgaccgctacgccgcagaccgacgtctccgtcaatacaggcacgaccgggttcgggtcctacacccttggactcgacagcgtgggtaacagccaggcccaggatatgatcgtcggcacgggcaacacctctgccacgtcggtcgccatggtccgcaatgaagctgctgccggtacaccggaaaccatcgacaacacgaacggtgtcaacgaccttctggtctttggcaatgccggcgatacgaacgttctcgccgggcagaattccactacgacaatcatgaacaacgccgccggggaccatggcacggtggaatacaccggggctacgggtgccagtgcgacgattctcgccggacctctgacggaaattcaggccgccggtacgacaaacctgatcatgggatcgcaatccgatacgacgacgtccgatgcctatatcacgggtggccagtacgacagtgccgaccagaccaacatcaccactgagggcccggcaggacaactggacgcgatcgacaatcaaggcaacgcacatacgacgcttcaggtcgcaagtccgaccgacctcctctataccggccgcgacaccacgttgaatcttggcactgacggccagaagtcgaccatcaactctcttggtaacgaccagattcatatgaacggatcgaacgtgaatgtggcgtccgtcaccggagggttcgacacgttctatggtggcaccggcaccatgaccatcaacgccagccagtcggtcggctatacgcaggaaacctatatcggcagccagacgtccggcgggagcctgacctatacaggcggcaacgctgcgaaccagatcacgctgggcgacgaaagcagcgttgcgatcacggccggcgccggggctatgaacatcaccgcaaacgacagcaccggtctttgggccaacctgacgaacgcggcatcggcggacctgaactttgggtccagccttggcaactctatgatctacggcttcaacggaagcactgacagtgcgaccatgcagggtgtcaccgggacctccttctcggggggcaacctgatggtcagcctggctgacaatcacagcatcacgttcttcgacgtccatacccttcagggcatgaacatcgtcggcgcctaa

SEQ ID NO: 26 - protein, 1284 aa, Gluconobacter oxydans
MADNSDEQFVASDYTLLGDATDDPNGMVDMPAGQEPATTNAVPSGVEYNFLAATAGYYTVSFAYQNTANAAAYEQLSINGQNEPGVVEFDQTSGASTGTAYASVYLKAGLNSVELNNQTTDETNGLTPVPEDQLQASPAFQIGTSTVAAGASPSQETSAQSLAISNQTDMQAFVQGESMAPKQQWTFGPSLSELHVGSNDELNQLDFNAVWFRNVTPGQQAETYSPYFKSNESFDANGVLHVNYGAYSPTGQALPVQIQATYANVPNENLIVENLSLTNQNASGTQPLVWDVMNATGINPGEVSSTTWDPTHNAWIVTEDQGSGKSPLYLAIGDYQVSNSTHAAGVDGVNVRGSYSLSSGASGNPSLNAPDQGVIGGFENNGTMVGSSSGASGTNLAVGTTDSDVTLNPGQTVDLSYYLSTATSLSQLDANLDKYTNTVGSTTSSTPMTDATGASAASSWTQQTATAWDDTLNQAYNLAGSTETSGQAATAASGQTLDPTSSAAAQSAYRSSLINILQAQSPEYGSFMASTNPSYEYKVWVRDSAATAIGLDDAGLTQPADKFWRWMASVEQNGMNATYSGNASGTFSTNYGEFDQNLPIGFVAPENDSQGLFLIGSYRHYEQMLSEGQTQQAQSFISDPTVRQALVNSANWIQENIGSNGLGPADYSIWEDMYGYHTFTQVTYAEGLNAASQLASAMGEGNQAQTWATGAETIKDAILRPTTASTPGLWNAQEGHFVEMINPNGTIDNTIDADTNIAAVFGLVSPTSIYATENAQAVENALTQDNFGLSRYQNETFYQSSQWSPGGTYEAQGISPSWPQMTAYDSIVSMDSGNTTQANNDLSWIEQSYDNGGTPPGESYDWARGQPIESTSSEPVTASWYVQDLLNSTGQTSTLMPAITGQAPTATPQTDVSVNTGTTGFGSYTLGLDSVGNSQAQDMIVGTGNTSATSVAMVRNEAAAGTPETIDNTNGVNDLLVFGNAGDTNVLAGQNSTTTIMNNAAGDHGTVEYTGATGASATILAGPLTEIQAAGTTNLIMGSQSDTTTSDAYITGGQYDSADQTNITTEGPAGQLDAIDNQGNAHTTLQVASPTDLLYTGRDTTLNLGTDGQKSTINSLGNDQIHMNGSNVNVASVTGGFDTFYGGTGTMTINASQSVGYTQETYIGSQTSGGSLTYTGGNAANQITLGDESSVAITAGAGAMNITANDSTGLWANLTNAASADLNFGSSLGNSMIYGFNGSTDSATMQGVTGTSFSGGNLMVSLADNHSITFFDVHTLQGMNIVGA

SEQ ID NO: 27 - DNA, 2085 bp, Escherichia coli
atggaaagcaaacgtctggataatgccgcgctggcggcggggattagccccaattacatcaatgcccacggtaaaccgcagtcgattagcgccgaaaccaaacggcgtttgcttgacgcgatgcatcaacgtaccgccacgaaagtggcggtaacgccagtcccgaatgtcatggtttataccagcggcaaaaaaatgccgatggtggtggagggcagcggcgaatatagctggctgctgaccaccgaagaaggaacgcagtacaaaggccatgtaacggggggcaaagcgttcaatctaccgacgaagctgccggaaggttatcacacgctgacactcacccaggacgaccagcgcgcgcattgccgggtgattgtcgccccgaaacgctgttacgaaccgcaggcgttgctgaataaacaaaagctgtggggtgcctgcgttcagctttatacgctgcgatcggaaaaaaactggggtattggggattttggcgatctcaaagcgatgctggtggatgtggcaaaacgtggcgggtcgttcattggcctgaacccgattcatgcgctctatccggcaaatccggagagcgccagcccatacagcccgtcttctcgccgttggctgaatgtgatttatatcgacgttaacgccgttgaagatttccatcttagcgaagaggctcaggcctggtggcagttgccgaccacgcaacagacgctgcaacaggcgcgcgatgccgactgggtcgattactccacggttaccgccctaaaaatgacagcattacgaatggcgtggaaaggtttcgcgcaacgtgatgatgagcagatggccgcgtttcgccagtttgttgcagagcagggcgacagcctgttctggcaggcagcctttgatgcgctacatgcccagcaagtgaaagaggacgaaatgcgctggggctggcctgcatggccagagatgtatcagaacgtggattcaccagaagtgcgtcagttctgcgaagaacatcgtgatgacgtcgatttttatctctggttgcagtggctggcttacagccagtttgccgcctgctgggagataagccagggctatgaaatgccgattggcttgtatcgtgatctggcggttggcgtagcggaaggtggggcggaaacctggtgtgaccgtgaactatattgcctgaaagcatcggttggcgcgccgccggatatcctcggcccgttggggcagaactggggattaccgccaatggacccgcatatcatcaccgcgcgtgcctatgaaccgtttatcgagctgttgcgtgccaatatgcaaaactgcggcgcattacgaattgaccatgtgatgtcgatgctgcgtttgtggtggataccgtatggcgagacggcagatcagggcgcgtatgttcactatccggtggatgatctgctctcgattctggcactcgaaagtaaacgtcatcgctgtatggtgattggtgaagatctcggtaccgtaccggtagagattgtcggtaagctgcgcagcagcggtgtgtactcttacaaagtgctctatttcgaaaacgaccacgagaagacgttccgtgcaccgaaagcgtatccggagcagtcgatggcggttgcggcgacacatgacctgccaacgctgcgcggttactgggagtgcggggatctaacgctgggcaaaaccctggggctgtatccggatgaagtggtactgcgcggtctgtatcaggatcgcgaactggcgaagcaagggctgctggatgcactgcataaatatggttgtctgccgaaacgtgccgggcataaggcatcgttgatgtcgatgacgccgacgctgaaccgtggtttgcagcgctacattgccgacagtaacagtgctctgttaggactacagccggaagactggctggatatggccgaaccggtgaatattcctggcaccagttaccagtataaaaactggcgacgcaagctttccgcaacgcttgagtcgatgtttgccgatgatggcgtgaacaagttgctgaaggatttggacagacggcgcagagctgcagcgaagaagaagtag

SEQ ID NO: 28 - DNA, 2031 bp, Escherichia coli
atgaaactcgccgcctgttttctgacactccttcctggcttcgccgttgccgccagctggacttctccggggtttcccgcctttagcgaacaggggacaggaacatttgtcagccacgcgcagttgcccaaaggtacgcgtccactaacgctaaattttgaccaacagtgctggcagcctgcggatgcgataaaactcaatcagatgctttccctgcaaccttgtagcaacacgccgcctcaatggcgattgttcagggacggcgaatatacgctgcaaatagacacccgctccggtacgccaacattgatgatttccatccagaacgccgccgaaccggtagcaagcctggtccgtgaatgcccgaaatgggatggattaccgctcacagtggatgtcagcgccactttcccggaaggagccgccgtacgggattattacagccagcaaattgcgatagtgaagaacggtcaaataatgttacaacccgctgccaccagcaacggtttactcctgctggaacgggcagaaactgacacatccgcccctttcgactggcataacgccacggtttactttgtgctgacagatcgtttcgaaaacggcgatcccagtaatgaccagagttacggacgtcataaagacggtatggcggaaattggcacttttcacggcggcgatttacgcggcctgaccaacaaactggattacctccagcagttgggcgttaatgctttatggataagcgccccatttgagcaaattcacggctgggtcggcggcggtacaaaaggcgatttcccgcattatgcctaccacggttattacacacaggactggacgaatcttgatgccaatatgggcaacgaagccgatctacggacgctggttgatagcgcacatcagcgcggtattcgtattctctttgatgtcgtgatgaaccacaccggctatgccacgctggcggatatgcaggagtatcagtttggcgcgttatatctttctggtgacgaagtgaaaaaatcgctgggtgaacgctggagcgactggaaacctgccgccgggcaaacctggcatagctttaacgattacattaatttcagcgacaaaacaggctgggataaatggtggggaaaaaactggatcagaacggatatcggcgattacgacaatcctggattcgacgatctcactatgtcgctagcctttttgccggatatcaaaaccgaatcaactaccgcttctggtctgccggtgttctataaaaacaaaatggatacccacgccaaagccattgacggctatacgccgcgcgattacttaacccactggttaagtcagtgggtccgcgactatgggattgatggttttcgggtcgataccgccaaacatgttgagttgcccgcctggcagcaactgaaaaccgaagccagcgccgcgcttcgcgaatggaaaaaagctaaccccgacaaagcattagatgacaaacctttctggatgaccggtgaagcctggggccacggcgtgatgcaaagtgactactatcgccacggcttcgatgcgatgatcaatttcgattatcaggagcaggcggcgaaagcagtcgactgtctggcgcagatggatacgacctggcagcaaatggcggagaaattgcagggtttcaacgtgttgagctacctctcgtcgcatgatacccgcctgttccgtgaagggggcgacaaagcagcagagttattactattagcgccaggcgcggtacaaatcttttatggtgatgaatcctcgcgtccgttcggtcctacaggttctgatccgctgcaaggtacacgttcggatatgaactggcaggatgttagcggtaaatctgccgccagcgtcgcgcactggcagaaaatcagccagttccgcgcccgccatcccgcaattggcgcgggcaaacaaacgacacttttgctgaagcagggctacggctttgttcgtgagcatggcgacgataaagtgctggtcgtctgggcagggcaacagtaa

SEQ ID NO: 29 - DNA, 2394 bp, Escherichia coli
atgtcacaacctatttttaacgataagcaatttcaggaagcgctttcacgtcagtggcagcgttatggcttaaattctgcggctgaaatgactcctcgccagtggtggctagcagtgagtgaagcactggccgaaatgctgcgtgctcagccattcgccaagccggtggcgaatcagcgacatgttaactacatctcaatggagtttttgattggtcgcctgacgggcaacaacctgttgaatctcggctggtatcaggatgtacaggattcgttgaaggcttatgacatcaatctgacggacctgctggaagaagagatcgacccggcgctgggtaacggtggtctgggacgtctggcggcgtgcttcctcgactcaatggcaactgtcggtcagtctgcgacgggttacggtctgaactatcaatatggtttgttccgccagtcttttgtcgatggcaaacaggttgaagcgccggatgactggcatcgcagtaactacccgtggttccgccacaacgaagcactggatgtgcaggtagggattggcggtaaagtgacgaaagacggacgctgggagccggagtttaccattaccggtcaagcgtgggatctccccgttgtcggctatcgtaatggcgtggcgcagccgctgcgtctgtggcaggcgacgcacgcgcatccgtttgatctgactaaatttaacgacggtgatttcttgcgtgccgaacagcagggcatcaatgcggaaaaactgaccaaagttctctatccaaacgacaaccatactgccggtaaaaagctgcgcctgatgcagcaatacttccagtgtgcctgttcggtagcggatattttgcgtcgccatcatctggcggggcgtaaactgcacgaactggcggattacgaagttattcagctgaacgatacccacccaactatcgcgattccagaactgctgcgcgtgctgatcgatgagcaccagatgagctgggatgacgcctgggccattaccagcaaaactttcgcttacaccaaccataccctgatgccagaagcgctggaacgctgggatgtgaaactggtgaaaggcttactgccgcgccacatgcagattattaacgaaattaatactcgctttaaaacgctggtagagaaaacctggccgggcgatgaaaaagtgtgggccaaactggcggtggtgcacgacaaacaagtgcatatggcgaacctgtgtgtggttggcggtttcgcggtgaacggtgttgcggcgctgcactcggatctggtggtgaaagatctgttcccggaatatcaccagctatggccgaacaaattccataacgtcaccaacggtattaccccacgtcgctggatcaaacagtgcaacccggcactggcggctctgttggataaatcactgcaaaaagagtgggctaacgatctcgatcagctgatcaatctggaaaaattcgctgatgatgcgaaattccgtcagcaatatcgcgagatcaagcaggcgaataaagtccgtctggcggagtttgtgaaagttcgtaccggtattgagatcaatccacaggcgattttcgatattcagatcaaacgtttgcatgagtacaaacgccagcacctgaatctgctgcatattctggcgttgtacaaagaaattcgtgaaaacccgcaggctgatcgcgtaccgcgcgtcttcctcttcggcgcgaaagcggcaccgggctactacctggcgaagaatattatctttgcgatcaacaaagtggctgacgtgatcaacaacgatccgctggttggcgataagttgaaggtggtgttcctgccggattattgcgtttcggcggcggaaaaactgatcccggcggcggatatctccgaacaaatttcgactgcaggtaaagaagcttccggtaccggcaatatgaaactggcgctcaatggtgcgcttactgtcggtacgctggatggggcgaacgttgaaatcgccgagaaagtcggtgaagaaaatatctttatttttggtcataccgtggaacaagtgaaggcaattctggccaaaggctacgacccggtgaaatggcggaagaaagataaggtgctggacgcagtattgaaagagctggaaagcggtaaatacagcgacggcgataagcatgccttcgaccagatgctgcacagtatcggcaaacagggcggcgatccgtatctggtgatggcggatttcgcagcctatgtagaggcacaaaagcaggtggatgtgctgtaccgcgaccaggaggcctggactcgcgcggcgatcctcaataccgcccgctgcggtatgtttagctcggatcgctctattcgcgattatcaggctcgtatctggcaggcaaaacgctaa

SEQ ID NO: 30 - DNA, 1815 bp, Escherichia coli
atgttaaatgcatggcacctgccggtgcccccatttgttaaacaaagcaaagatcaactgctcattacactgtggctgacgggcgaagacccaccgcagcgcattatgctgcgtacagaacacgataacgaagaaatgtcagtaccgatgcataagcagcgcagtcagccgcagcctggcgtcaccgcatggcgtgcggcgattgatctctccagcggacaaccccggcggcgttacagtttcaaactgctgtggcacgatcgccagcgttggtttacaccgcagggcttcagccgaatgccgccggcacgactggagcagtttgccgtcgatgtaccggatatcggcccacaatgggctgcggatcagattttttatcagatcttccctgatcgttttgcgcgtagtcttcctcgtgaagctgaacaggatcatgtctattaccatcatgcagccggacaagagatcatcttgcgtgactgggatgaaccggtcacggcgcaggcgggcggatcaacgttctatggcggcgatctggacgggataagcgaaaaactgccgtatctgaaaaagcttggcgtgacagcgctgtatctcaatccggtgtttaaagctcccagcgtacataaatacgataccgaggattatcgccatgtcgatccgcagtttggcggtgatggggcgttgctgcgtttgcgacacaatacgcagcagctgggaatgcggctggtgctggacggcgtgtttaaccacagtggcgattcccatgcctggtttgacaggcataatcgtggcacgggtggtgcttgtcacaaccccgaatcgccctggcgcgactggtactcgtttagtgatgatggcacggcgctcgactggcttggctatgccagcttgccgaagctggattatcagtcggaaagtctggtgaatgaaatttatcgcggggaagacagtattgtccgccactggctgaaagcgccgtggaatatggacggctggcggctggatgtggtgcatatgctgggggaggcgggtggggcgcgcaataatatgcagcacgttgccgggatcaccgaagcggcgaaagaaacccagccggaagcgtatattgtcggcgaacattttggcgatgcacggcaatggttacaggccgatgtggaagatgccgccatgaactatcgtggcttcacattcccgttgtggggatttcttgccaataccgatatctcttacgatccgcagcaaattgatgcccaaacctgtatggcctggatggataattaccgcgcagggctttctcatcaacaacaattacgtatgtttaatcagctcgacagccacgatactgcgcgatttaaaacgctgctcggtcgggatattgcgcgcctgccgctggcggtggtctggctgttcacctggcctggtgtaccgtgcatttattacggtgatgaagtaggactggatggcaaaaacgatccgttttgccgtaaaccgttcccctggcaggtggaaaagcaggatacggcgttattcgcgctgtaccagcgaatgattgcgctgcgtaagaaaagtcaggcgctacgtcatggcggctgtcaggtgctgtatgcggaagataacgtggtggtatttgtccgcgtgctgaatcagcaacgtgtactggtggcaatcaaccgtggcgaggcctgtgaagtggtgctacccgcgtcaccgtttctcaatgccgtgcaatggcaatgcaaagaagggcatgggcaactgactgacgggattctggctttgcctgccatttcggctacggtatggatgaactaa

SEQ ID NO: 31 - DNA, 1488 bp, Escherichia coli
atgcgtaatcccacgctgttacaatgttttcactggtattacccggaaggcggtaagctctggcctgaactggccgagcgcgccgacggttttaatgatattggtatcaatatggtctggttgccgcccgcctataaaggcgcatcgggcgggtattcggtcggctacgactcctatgatttatttgatttaggcgagtttgatcagaaaggcagcatccctactaaatatggcgataaagcacaactgctggccgccattgatgctctgaaacgtaatgacattgcggtgctgttggatgtggtagtcaaccacaaaatgggcgcggatgaaaaagaagctattcgcgtgcagcgtgtaaatgctgatgaccgtacgcaaattgacgaagaaatcattgagtgtgaaggctggacgcgttacaccttccccgcccgtgccgggcaatactcgcagtttatctgggatttcaaatgttttagcggtatcgaccatatcgaaaaccctgacgaagatggcatttttaaaattgttaacgactacaccggcgaaggctggaacgatcaggttgatgatgaattaggtaatttcgattatctgatgggcgagaatatcgattttcgcaatcatgccgtgacggaagagattaaatactgggcgcgctgggtgatggaacaaacgcaatgcgacggttttcgtcttgatgcggtcaaacatattccagcctggttttataaagagtggatcgaacacgtacaggaagttgcgccaaagccgctgtttattgtggcggagtactggtcgcatgaagttgataagctgcaaacgtatattgatcaggtggaaggcaaaaccatgctgtttgatgcgccgctgcagatgaaattccatgaagcatcgcgcatggggcgcgactacgacatgacgcagattttcacgggtacattagtggaagccgatcctttccacgccgtgacgctcgttgccaatcacgacacccaaccgttgcaagccctcgaagcgccggtcgaaccgtggtttaaaccgctggcgtatgccttaattttgttgcgggaaaatggcgttccttcggtattctatccggacctctacggtgcgcattacgaagatgtcggtggtgacgggcaaacctatccgatagatatgccaataatcgaacagcttgatgagttaattctcgcccgtcagcgtttcgcccacggtgtacagacgttatttttcgaccatccgaactgcattgcctttagccgcagtggcaccgacgaatttcccggctgcgtggtggtcatgtcgaacggggatgatggcgaaaaaaccattcatctgggagagaattacggcaataaaacctggcgtgattttctggggaaccggcaagagagagtagtgaccgacgaaaacggcgaagcaaccttcttttgcaacggcggcagcgtcagcgtgtgggttatcgaagaggtgatttaa

SEQ ID NO: 32 - DNA, 36 bp, artificial sequence
  synthetic construct
ataaaaaacgctcggttgccgccgggcgttttttat

SEQ ID NO: 33 - DNA, 21 bp, artificial sequence
  synthetic construct
ggatcctgactgcctgagctt

SEQ ID NO: 34 - protein, 26 aa, Bacillus subtilis
MRSKKLWISLLFALTLIFTMAFSNMS

SEQ ID NO: 35 - protein, 1449 aa, Streptococcus salivarius
MDKKVHYKMHKVKKQWVTIAVTGLSLGAVSAVSLGTNDGVVQADEHTDATVAIPDITVDTGTVSNDTTAAQDPTTAVAATNDVATDQATPTATFDLTTDTTNTVAANAVDTVATVGTDRAATTNDTTATNDTAVDTTNNNTTTDTTTVTDRAATTERRATGARRGPTGGRRATPVNGNTNNANNTVTVVNNDLPATNNVVTDGPSHIKTINGKQYYVEDDGTIRKNYVLERIGGSQYFNAETGELSNQKEYRFDKNGGTGSSADSTNTNVTVNGDKNAFYGTTDKDIELVDGYFTANTWYRPKEILKDGKEWTASTENDKRPLLTVWWPSKAIQASYLNYMKEQGLGTNQTYTSFSSQTQMDQAALEVQKRIEERIAREGNTDWLRTTIKNFVKTQPGWNSTSENLDNNDHLQGGALLYNNDSRTSHANSDYRLLNRTPTSQTGKHNPKYTKDTSNGGFEFLLANDIDNSNPAVQAEQLNWLHYIMNIGTITGGSEDENFDGVRVDAVDNVNADLLQIASDYFKAKYGADQSQDQAIKHLSILEAWSHNDAYYNEDTKGAQLPMDDPMHLALVYSLLRPIGNRSGVEPLISNSLNDRSESGKNSKRMANYAFVRAHDSEVQSIIGQIIKNEINPQSTGNTFTLDEMKKAFEIYNKDMRSANKQYTQYNIPSAYALMLTHKDTVPRVYYGDMYTDDGQYMAQKSPYYDAIETLLKGRIRYAAGGQDMKVNYIGYGNTNGWDAAGVLTSVRYGTGANSASDTGTAETRNQGMAVIVSNQPALRLTSNLTINMGAAHRNQAYRPLLLTTNDGVATYLNDSDANGIVKYTDGNGNLTFSANEIRGIRNPQVDGYLAVWVPVGASENQDVRVAPSKEKNSSGLVYESNAALDSQVIYEGFSNFQDFVQNPSQYTNKKIAENANLFKSWGITSFEFAPQYVSSDDGSFLDSVIQNGYAFTDRYDIGMSKDNKYGSLADLKAALKSLHAVGISAIADWVPDQIYNLPGDEVVTATRVNNYGETKDGAIIDHSLYAAKTRTFGNDYQGKYGGAFLDELKRLYPQIFDRVQISTGKRMTTDEKITQWSAKYMNGTNILDRGSEYVLKNGLNGYYGTNGGKVSLPKVVGSNQSTNGDNQNGDGSGKFEKRLFSVRYRYNNGQYAKNAFIKDNDGNVYYFDNSGRMAVGEKTIDGKQYFFLANGVQLRDGYRQNRRGQVFYYDQNGVLNANGKQDPKPDNNNNASGRNQFVQIGNNVWAYYDGNGKRVTGHQNINGQELFFDNNGVQVKGRTVNENGAIRYYDANSGEMARNRFAEIEPGVWAYFNNDGTAVKGSQNINGQDLYFDQNGRQVKGALANVDGNLRYYDVNSGELYRNRFHEIDGSWYYFDGNGNAVKGMVNINGQNLLFDNNGKQIKGHLVRVNGVVRYFDPNSGEMAVNRWVEVSPGWWVYFDGEGRGQI

SEQ ID NO: 36 - DNA, 3744 bp, Streptococcus salivarius
atgccaagccacattaagaccatcaacggcaaacaatactacgtggaggatgacggtacgattcgcaagaattacgtcctggagcgtatcggtggcagccaatactttaatgcagaaaccggtgaactgtctaatcagaaagagtatcgtttcgacaaaaatggtggtactggtagcagcgcggacagcacgaacaccaacgtgactgtgaacggtgacaaaaacgcattttacggtaccacggacaaagacattgagctggtcgacggctatttcaccgcgaacacctggtatcgcccgaaagaaatcctgaaagacggcaaagaatggaccgccagcacggagaacgataaacgcccgctgctgaccgtctggtggcctagcaaagcaatccaggcgtcttatctgaactacatgaaagagcaaggcctgggtaccaaccaaacgtacacgagcttctccagccaaacccaaatggatcaagcagccctggaagtgcaaaagcgtattgaagagcgcatcgcacgcgagggcaataccgactggctgcgcacgaccatcaagaacttcgtgaaaacccaaccgggttggaacagcacctctgaaaatctggacaataatgatcatctgcaaggtggcgccctgctgtacaataacgactcccgcacgagccacgcgaacagcgactatcgcctgctgaatcgtacgccgaccagccagaccggcaaacacaatccgaaatacaccaaagataccagcaatggtggtttcgaatttctgctggcgaacgacatcgataactctaatccggcggttcaagcagagcaactgaactggctgcattacattatgaacatcggtaccatcacgggcggttctgaggatgaaaacttcgacggcgttcgtgttgacgctgtggataatgtgaatgcggatctgctgcaaatcgcgagcgactatttcaaagcaaaatacggtgctgatcaaagccaagatcaggcgatcaaacacttgagcatcctggaagcgtggtcccataacgacgcctactataacgaagataccaaaggcgcgcagttgccgatggatgatccgatgcacctggctctggtctactcgctgctgcgtccgatcggcaatcgcagcggtgtggaaccgctgatttccaacagcctgaatgaccgtagcgagtccggtaagaacagcaaacgtatggcgaactacgcgttcgtacgcgcgcatgatagcgaggtgcaatcgattattggccagatcatcaaaaacgagatcaatccgcaaagcaccggtaatacgttcaccctggatgagatgaagaaagcgtttgagatttacaacaaggatatgcgtagcgcgaataagcagtatacgcagtacaacatcccgagcgcgtatgcgttgatgctgacccacaaggataccgttccgcgtgtgtattacggtgatatgtatacggacgacggtcagtacatggcgcaaaagagcccatactatgatgcgatcgaaacgctgctgaaaggtcgcatccgctatgccgcaggtggtcaggacatgaaggtcaactatattggttacggtaacactaacggctgggatgctgcgggcgtgctgaccagcgtacgttatggcacgggcgcaaatagcgccagcgatacgggtaccgccgaaacgcgtaatcaaggtatggcagtgattgttagcaaccaaccggcgctgcgtctgactagcaatttgaccattaacatgggtgccgcacaccgtaatcaggcttaccgtccgctgctgctgacgaccaacgatggcgtcgcgacctatttgaacgatagcgatgcgaatggtatcgttaagtacaccgacggtaatggtaatctgaccttctccgcaaacgagattcgtggcatccgtaacccgcaagttgatggctatctggccgtctgggttccggtaggtgcgtcggagaatcaggatgttcgtgtggcgccgagcaaagagaagaacagctccggtctggtttacgagagcaatgctgccctggatagccaagttatctacgaaggcttcagcaacttccaggacttcgttcagaatccgagccagtataccaacaaaaagattgcagagaatgcaaatttgttcaaatcctggggtattaccagctttgaatttgcgccgcagtacgtgagctcggatgatggtagcttcctggacagcgttattcagaacggttatgcgtttacggaccgctacgacattggtatgagcaaagacaacaaatatggttcgctggcggatttgaaggcagcactgaagagcttgcatgccgttggtattagcgcaatcgcggattgggttcctgatcagatctacaatctgccaggcgacgaggtcgtcaccgcaacccgcgttaacaactacggcgaaaccaaagatggtgcaatcattgatcactctttgtacgcggccaaaacccgtacttttggtaacgactaccagggtaagtatggtggtgcgttcctggacgagctgaaacgtctgtatccgcagatctttgaccgcgttcagatttctaccggtaagcgcatgaccacggacgagaagatcacccaatggtctgcaaagtatatgaacggtacgaacatcttggaccgtggctctgaatacgttttgaagaatggtctgaatggttactatggcaccaatggtggcaaagtttcgctgccgaaagttgtgggtagcaatcaaagcacgaatggcgacaatcaaaacggcgacggtagcggcaagtttgaaaagcgtctgttcagcgtgcgttaccgttataacaatggccagtacgcgaaaaatgcctttatcaaagataacgacggcaatgtttactatttcgacaatagcggtcgtatggctgtcggtgagaaaacgattgacggcaagcagtacttcttcctggctaatggcgttcagctgcgtgacggctaccgtcaaaatcgtcgcggtcaggtgttttactacgaccagaatggtgtgctgaacgcaaacggtaaacaagacccgaagcctgacaacaataacaatgcgagcggccgtaatcaattcgtccagatcggtaacaacgtgtgggcgtattatgatggcaatggtaaacgtgtcaccggtcaccagaacatcaacggtcaggagttgtttttcgataacaacggtgtccaggttaagggtcgtacggtgaatgagaacggtgcaattcgctactatgacgcgaatagcggtgagatggcacgcaatcgtttcgcggagattgaaccgggcgtctgggcatactttaacaatgacggcaccgcagtgaagggttctcagaatatcaatggtcaagacctgtacttcgaccagaacggtcgtcaggtcaagggtgcgctggccaatgttgatggcaacctgcgctattacgacgttaacagcggtgagctgtaccgtaatcgtttccacgaaatcgacggcagctggtattactttgatggtaacggtaatgcggtgaagggtatggtcaatatcaacggccaaaatctgttgtttgacaataacggcaaacagattaagggtcatctggtccgcgtcaacggcgtcgtgcgctattttgatccgaactctggtgaaatggcggttaatcgttgggttgaggtgagcccaggttggtgggtttactttgacggtgaaggtcgtggtcagatctaa

SEQ ID NO: 37 - protein, 1247 aa, Streptococcus salivarius
MPSHIKTINGKQYYVEDDGTIRKNYVLERIGGSQYFNAETGELSNQKEYRFDKNGGTGSSADSTNTNVTVNGDKNAFYGTTDKDIELVDGYFTANTWYRPKEILKDGKEWTASTENDKRPLLTVWWPSKAIQASYLNYMKEQGLGTNQTYTSFSSQTQMDQAALEVQKRIEERIAREGNTDWLRTTIKNFVKTQPGWNSTSENLDNNDHLQGGALLYNNDSRTSHANSDYRLLNRTPTSQTGKHNPKYTKDTSNGGFEFLLANDIDNSNPAVQAEQLNWLHYIMNIGTITGGSEDENFDGVRVDAVDNVNADLLQIASDYFKAKYGADQSQDQAIKHLSILEAWSHNDAYYNEDTKGAQLPMDDPMHLALVYSLLRPIGNRSGVEPLISNSLNDRSESGKNSKRMANYAFVRAHDSEVQSIIGQIIKNEINPQSTGNTFTLDEMKKAFEIYNKDMRSANKQYTQYNIPSAYALMLTHKDTVPRVYYGDMYTDDGQYMAQKSPYYDAIETLLKGRIRYAAGGQDMKVNYIGYGNTNGWDAAGVLTSVRYGTGANSASDTGTAETRNQGMAVIVSNQPALRLTSNLTINMGAAHRNQAYRPLLLTTNDGVATYLNDSDANGIVKYTDGNGNLTFSANEIRGIRNPQVDGYLAVWVPVGASENQDVRVAPSKEKNSSGLVYESNAALDSQVIYEGFSNFQDFVQNPSQYTNKKIAENANLFKSWGITSFEFAPQYVSSDDGSFLDSVIQNGYAFTDRYDIGMSKDNKYGSLADLKAALKSLHAVGISAIADWVPDQIYNLPGDEVVTATRVNNYGETKDGAIIDHSLYAAKTRTFGNDYQGKYGGAFLDELKRLYPQIFDRVQISTGKRMTTDEKITQWSAKYMNGTNILDRGSEYVLKNGLNGYYGTNGGKVSLPKVVGSNQSTNGDNQNGDGSGKFEKRLFSVRYRYNNGQYAKNAFIKDNDGNVYYFDNSGRMAVGEKTIDGKQYFFLANGVQLRDGYRQNRRGQVFYYDQNGVLNANGKQDPKPDNNNNASGRNQFVQIGNNVWAYYDGNGKRVTGHQNINGQELFFDNNGVQVKGRTVNENGAIRYYDANSGEMARNRFAEIEPGVWAYFNNDGTAVKGSQNINGQDLYFDQNGRQVKGALANVDGNLRYYDVNSGELYRNRFHEIDGSWYYFDGNGNAVKGMVNINGQNLLFDNNGKQIKGHLVRVNGVVRYFDPNSGEMAVNRWVEVSPGWWVYFDGEGRGQI

SEQ ID NO: 38 - protein, 1590 aa, Streptococcus sobrinus
MEKNVRFKMHKVKKRWVTLSVASATMLASALGASVASADTDTASDDSNQAVVTGDQTTNNQATDQTSIAATATSEQSASTDAATDQASAAEQTQGTTASTDTAAQTTTNANEAKWVPTENENQGFTDEMLAEAKNVATAESDSIPSDLAKMSNVKQVDGKYYYYDQDGNVKKNFAVSVGDKIYYFDETGAYKDTSKVDADKSSSAVSQNATIFAANNRAYSTSAKNFEAVDNYLTADSWYRPKSILKDGKTWTESGKDDFRPLLMAWWPDTETKRNYVNYMNKVVGIDKTYTAETSQADLTAAAELVQARIEQKITSENNTKWLREAISAFVKTQPQWNGESEKPYDDHLQNGALLFDNQTDLTPDTQSNYRLLNRTPTNQTGSLDSRFTYNPNDPLGGYDFLLANDVDNSNPVVQAEQLNWLHYLLNFGSIYANDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDIIRDIIKAEINPNSFGYSFTQEEIEQAFKIYNEDLKKTDKKYTHYNVPLSYTLLLTNKGSIPRVYYGDMFTDDGQYMANKTVNYDAIESLLKARMKYVSGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQVSNKYFNVASDTLFLPSSLLGKVVESGIRYDGKGYIYNSSATGDQVKASFITEAGNLYYFGKDGYMVTGAQTINGANYFFLENGTALRNTIYTDAQGNSHYYANDGKRYENGYQQFGNDWRYFKDGNMAVGLTTVDGNVQYFDKDGVQAKDKIIVTRDGKVRYFDQHNGNAATNTFIADKTGHWYYLGKDGVAVTGAQTVGKQKLYFEANGQQVKGDFVTSDEGKLYFYDVDSGDMWTDTFIEDKAGNWFYLGKDGAAVTGAQTIRGQKLYFKANGQQVKGDIVKGTDGKIRYYDAKSGEQVFNKTVKAADGKTYVIGNDGVAVDPSVVKGQTFKDASGALRFYNLKGQLVTGSGWYETANHDWVYIQSGKALTGEQTINGQHLYFKEDGHQVKGQLVTGTDGKVRYYDANSGDQAFNKSVTVNGKTYYFGNDGTAQTAGNPKGQTFKDGSDIRFYSMEGQLVTGSGWYENAQGQWLYVKNGKVLTGLQTVGSQRVYFDENGIQAKGKAVRTSDGKIRYFDENSGSMITNQWKFVYGQYYYFGNDGARIYRGWN

SEQ ID NO: 39 - DNA, 4308 bp, Streptococcus sobrinus
atggttgacggcaaatactactattatgatcaggacggtaacgtaaagaagaatttcgcggtgagcgttggtgacaaaatctactacttcgatgaaactggtgcatataaggataccagcaaagtggacgccgacaagagcagcagcgcggttagccaaaacgcgaccatctttgcggcgaataaccgtgcgtacagcacctctgcaaagaattttgaagcggtggataactacctgaccgcagacagctggtatcgtccgaaatccatcctgaaggacggcaaaacctggaccgagagcggtaaggatgatttccgtccactgctgatggcatggtggcctgacaccgaaactaagcgcaactacgtgaactatatgaataaagtggtcggtattgacaagacgtacactgcggaaacgtcgcaagcggatttgaccgcagcggcggagctggttcaagcgcgtatcgagcagaagattaccagcgaaaacaacaccaaatggctgcgcgaagcaatctccgcgttcgttaagacgcagcctcagtggaacggcgagtccgaaaagccgtatgacgatcacttgcagaacggtgcgctgctgtttgataaccaaaccgacctgacgccagacacccaaagcaattaccgtttgctgaaccgtaccccgaccaatcagactggtagcctggatagccgttttacgtataatccgaatgacccgttgggcggctacgatttcttgctggcgaacgacgttgacaatagcaatccggtcgtccaggctgaacagttgaactggctgcattatctgctgaactttggctctatttacgctaacgatgccgacgccaattttgacagcattcgcgttgatgccgtcgataatgtcgatgctgatctgctgcaaatcagcagcgattacctgaaagcagcgtatggcatcgacaagaataacaagaatgcgaacaaccatgttagcatcgtcgaagcgtggagcgacaatgataccccgtatttgcacgacgatggcgataatctgatgaacatggacaacaaatttcgcctgtccatgctgtggagcctggcaaagccgctggacaaacgtagcggtttgaacccgctgattcacaatagcctggtggaccgcgaggtggacgatcgtgaagtggaaaccgtgccgtcctacagctttgctcgtgcacatgatagcgaggtgcaggacatcatccgtgacattatcaaggctgagattaacccaaatagctttggttatagcttcactcaagaagagatcgagcaagcctttaagatttacaacgaggatttgaagaaaacggacaagaaatacacccactacaatgtgccgctgagctacaccctgctgctgaccaacaagggcagcatcccgcgtgtgtactatggtgatatgttcaccgatgatggccaatacatggcaaacaagaccgtcaactacgacgcaatcgagagcctgctgaaagcccgtatgaaatatgtcagcggtggccaagcaatgcagaactatcaaattggtaatggcgagattttgaccagcgtgcgctatggtaaaggtgccctgaagcagagcgataagggtgacgcgacgacgcgcactagcggtgttggcgtggttatgggtaatcagccgaacttctccctggacggtaaagttgtggccctgaatatgggtgcggcccatgcgaatcaagaataccgtgcactgatggtcagcactaaagacggtgtggcaacttacgcaaccgatgctgacgcatccaaagcgggcctggtcaagcgtaccgacgagaacggctacctgtacttcctgaatgatgatctgaagggcgtcgcgaaccctcaggtttccggcttcttgcaagtgtgggttccagttggtgccgccgatgaccaggacattcgcgtcgccgccagcgacacggcgagcacggatggtaaaagcctgcatcaagatgcggcgatggacagccgcgtcatgtttgagggtttcagcaattttcaatccttcgcgaccaaagaagaagaatacacgaatgttgttatcgcgaacaatgtcgataagttcgttagctggggtatcaccgattttgaaatggctccgcagtatgttagcagcaccgacggtcagttcttggacagcgtcatccagaatggctatgcgtttactgatcgctatgatctgggtatgtccaaggcgaacaagtatggcacggcagaccaactggttaaggcaatcaaagccctgcacgctaaaggcctgaaagttatggcggactgggtcccggatcaaatgtacacctttccaaaacaggaagttgtgaccgttacccgcaccgacaaattcggtaaaccgatcgccggctctcaaatcaatcacagcttgtatgtgaccgacaccaaatccagcggcgacgactaccaagcgaagtacggcggtgccttcctggatgaactgaaagaaaagtacccggaactgttcacgaaaaagcaaattagcacgggccaagcgattgatccgagcgtgaaaatcaagcagtggagcgcaaaatacttcaatggttcgaatatcctgggtcgcggtgcggactatgtgctgagcgaccaggtcagcaataagtatttcaacgtggcgagcgacaccttgttcctgccgtccagcctgctgggcaaggtcgtggagagcggcattcgttacgacggcaagggttacatctacaacagctccgcgaccggcgatcaggtcaaagcgtctttcattacggaagccggtaacctgtattacttcggcaaagacggttacatggttactggtgcccagacgattaatggcgccaactacttcttcctggaaaacggtacggcactgcgtaatacgatttacaccgatgctcaaggtaatagccactattacgcgaatgatggcaaacgctatgaaaatggctatcaacagttcggtaacgattggcgctactttaaagatggtaacatggcagtcggcctgaccacggttgatggcaacgtgcaatactttgacaaagacggcgtccaggcaaaggataagattatcgtcacccgtgatggcaaggtccgttacttcgatcagcacaacggtaacgcggcgaccaacacgttcattgctgataaaactggccattggtattacctgggtaaagatggcgtcgcggtgactggcgcccagaccgtcggcaaacaaaaactgtacttcgaggccaacggtcaacaagttaaaggtgactttgttacgtccgatgagggcaaactgtatttctatgacgttgattctggtgacatgtggacggacaccttcatcgaggataaggcgggcaactggttctatttgggcaaggatggtgcggcagttacgggtgcccaaacgattcgcggtcagaagctgtacttcaaggccaatggtcaacaggtcaagggtgacattgttaagggcaccgacggtaaaatccgctactatgatgcaaaatccggtgaacaggtgttcaacaaaacggtgaaagctgcggatggcaaaacgtatgttatcggtaatgatggtgtcgcggtggaccctagcgtggttaaaggtcaaacctttaaggacgcttcgggcgctctgcgtttctacaacttgaagggtcaactggtcactggcagcggctggtatgaaaccgcgaaccatgactgggtttacattcagtccggcaaggcactgaccggcgaacagaccattaacggtcaacacctgtatttcaaagaagatggtcaccaagtcaagggtcagttggtcacgggcaccgatggtaaagtgcgttactatgacgccaacagcggtgaccaagcattcaacaagagcgtcactgtgaatggtaaaacctattactttggcaacgatggtacggcgcagactgctggcaacccgaagggtcagacgttcaaggatggctccgacatccgtttttactctatggaaggccaactggtgaccggctcgggttggtacgagaacgcgcaaggccagtggctgtatgtgaaaaacggtaaggtgctgactggtctgcaaaccgttggcagccagcgtgtttacttcgacgagaatggtattcaggccaagggcaaagcagtgcgtaccagcgatggcaaaattcgttatttcgacgaaaacagcggcagcatgatcacgaatcaatggaagttcgtctatggtcagtattactactttggtaacgacggtgcacgtatttaccgtggttggaactaa

SEQ ID NO: 40 - protein, 1435 aa, Streptococcus sobrinus
MVDGKYYYYDQDGNVKKNFAVSVGDKIYYFDETGAYKDTSKVDADKSSSAVSQNATIFAANNRAYSTSAKNFEAVDNYLTADSWYRPKSILKDGKTWTESGKDDFRPLLMAWWPDTETKRNYVNYMNKVVGIDKTYTAETSQADLTAAAELVQARIEQKITSENNTKWLREAISAFVKTQPQWNGESEKPYDDHLQNGALLFDNQTDLTPDTQSNYRLLNRTPTNQTGSLDSRFTYNPNDPLGGYDFLLANDVDNSNPVVQAEQLNWLHYLLNFGSIYANDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDIIRDIIKAEINPNSFGYSFTQEEIEQAFKIYNEDLKKTDKKYTHYNVPLSYTLLLTNKGSIPRVYYGDMFTDDGQYMANKTVNYDAIESLLKARMKYVSGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQVSNKYFNVASDTLFLPSSLLGKVVESGIRYDGKGYIYNSSATGDQVKASFITEAGNLYYFGKDGYMVTGAQTINGANYFFLENGTALRNTIYTDAQGNSHYYANDGKRYENGYQQFGNDWRYFKDGNMAVGLTTVDGNVQYFDKDGVQAKDKIIVTRDGKVRYFDQHNGNAATNTFIADKTGHWYYLGKDGVAVTGAQTVGKQKLYFEANGQQVKGDFVTSDEGKLYFYDVDSGDMWTDTFIEDKAGNWFYLGKDGAAVTGAQTIRGQKLYFKANGQQVKGDIVKGTDGKIRYYDAKSGEQVFNKTVKAADGKTYVIGNDGVAVDPSVVKGQTFKDASGALRFYNLKGQLVTGSGWYETANHDWVYIQSGKALTGEQTINGQHLYFKEDGHQVKGQLVTGTDGKVRYYDANSGDQAFNKSVTVNGKTYYFGNDGTAQTAGNPKGQTFKDGSDIRFYSMEGQLVTGSGWYENAQGQWLYVKNGKVLTGLQTVGSQRVYFDENGIQAKGKAVRTSDGKIRYFDENSGSMITNQWKFVYGQYYYFGNDGARIYRGWN

SEQ ID NO: 41 - protein, 1570 aa, Streptococcus sp.
MKKNWVTIGVTALSMVTVAGGTLLEDQQVQADEQNAANQSGDSSQDLLREASATTNDTATTVAPTISADANTASVNIPVADATNTTTAATDRAAAPTTTAATVDTNSGQAAPSTNVQAAAADTSATPTDTNTNTNASVTATDRAVATDTANTEARTPSRRALAETREANTNTSTGIQWINGKQYYVNSDGSVRKNFVFEQDGKSYYFDAETGALATKSQDEFSTEPIKAAVDFSSGNQLYKNDNKSLDQLDTFITADAWYRPKSILKDGKTWTASTEADKRPLLMVWWPDKSTQVNYLNYMQNQGLGAGSFSTNSSQESLNLAAKAVQTKIEERIAREGNTNWLRTSIDQFIKTQPGWNSSTENSSYDHLQGGQLLFNNSKGDTGNRTSYANSDYRLLNRTPTNQSGTRKYFKDNSIGGLEFLLANDIDNSNPAVQAEQLNWLHFMMNIGSIMANDPTANFDGLRVDALDNVDADLLQIASDYFKAVYGVDKSEANAIKHLSYLEAWSANDPYYNKDTKGAQLPIDNALRNALTNLLMRDKNTRMQLGDMTAFMNSSLNPRGANDKNGERMANYIFTRAHDTEAQTIIQRIIRDRINPNLFGYNFTRDEIKKAFEIYNADINTAHKTYASYNLPSVYALMLTNKDSVTRVYYGDLYREDGHYMAKKTPYFDAIDTLLRARIKYVAGGQDMEVKKVGNDGLLTSVRYGKGANNSTDWGTTETRTQGMGVILTNNYDFRLGSNETVTMNMGRAHRNQLYRPLLLTTKDGLATYLNDSDVPSNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGRYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQVIKNEFVQDGNGNWYYFGADGKMTKGAQNINSKDYYFFDNGVQLRNALRRASNGYTYYYGLDGAMIKNAFVDFDDKHQQVRAFTTQGTMVVGNLHWSGHHFYFDRETGIQAKDRIVRTDDGKLHYYVAQTGDMGRNVFATDSRTGKRYYFDADGNTVTGSRVIDGKTYYFNQDGSVGTAYSNRADSIIFENGKARYITPAGEIGRSIFVYNPATKAWNYFDKEGNRVTGRQYIDGNLYYFKEDGSQVKGAIVEENGIKYYYEPGSGILASGRYLQVGDDQWIYFKHDGSLAIGQVRADGGYLKYFDKNGIQVKGQTIVEDGHTYYYDADSGALVTSSFAEIAPNQWAYFNTEGQALKGKWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYIPGR

SEQ ID NO: 42 - DNA, 4182 bp, Streptococcus sp.
atgatcaatggcaaacagtactatgtaaattcggacggtagcgtgcgtaagaatttcgtttttgaacaggatggtaagagctactactttgacgcggaaactggcgcgctggccactaaaagccaagatgaatttagcacggagccgattaaagcagcagtggacttctctagcggcaaccagctgtacaaaaatgacaacaaatcgctggatcagctggatacgtttatcaccgctgacgcatggtaccgccctaagtctattctgaaggatggcaaaacctggaccgcgtctaccgaagctgataagcgtccgttgctgatggtgtggtggccggacaagtccacccaagttaactacctgaactacatgcagaaccagggtttgggtgcgggtagcttcagcaccaatagcagccaagaatccctgaatctggctgcgaaagcagttcagaccaagatcgaagaacgcatcgcacgtgagggtaacaccaattggctgcgtaccagcattgaccaattcattaagacgcagccaggctggaacagcagcactgagaatagcagctatgatcacttgcagggtggtcaactgctgttcaataacagcaaaggtgatacgggtaaccgcaccagctatgcgaatagcgactatcgtctgctgaaccgtaccccaactaatcaaagcggcacccgtaagtactttaaggataattccatcggtggtctggaatttctgctggcaaacgacatcgacaacagcaaccctgccgttcaggcggagcagctgaactggctgcacttcatgatgaacattggttctatcatggcgaatgacccgacggcgaactttgatggtttgcgtgtggacgcgttggataacgtggatgcggacctgttgcagatcgcgagcgattacttcaaggcagtctacggtgttgataaatccgaggcgaatgcgatcaagcacctgagctatctggaggcgtggagcgccaatgacccgtattacaacaaggataccaaaggcgcgcaactgccgattgacaacgcgctgcgcaacgcactgaccaacctgttgatgcgtgacaagaatacgcgcatgcagctgggtgacatgacggcgtttatgaatagctctctgaacccacgtggtgcgaatgacaaaaacggcgagcgtatggcgaattacattttcacccgcgcacacgataccgaggcgcagaccatcattcagcgtattatccgcgatcgtatcaatccgaacctgtttggctacaatttcacccgcgatgaaatcaaaaaggcgtttgagatctacaacgcggacattaacacggcgcataagacgtacgcgagctacaatctgccgtccgtctacgcactgatgctgacgaataaggacagcgtgacccgtgtgtattacggtgacctgtatcgtgaggacggtcactacatggccaagaaaacgccttatttcgatgcaatcgataccctgctgcgtgcgcgcatcaaatacgtggcgggtggtcaagacatggaggtgaagaaagttggtaatgacggcttgctgacgagcgtccgctatggcaagggtgcgaacaatagcaccgactggggcacgactgaaacccgtacccaaggtatgggcgttatcctgacgaacaactatgatttccgcctgggcagcaacgaaaccgtcacgatgaacatgggccgtgcgcatcgcaatcagctgtatcgtccgctgctgctgacgaccaaggatggtctggccacgtacctgaatgatagcgacgtgccttcgaatttgctgaaacgcacggactggaatggtaacttgacctttaatgccaacgatgtgtttggtgtagagaacgtccaggtcagcggttacctgggtgtttgggtaccggttggtgctaaagctaaccaggatgcgcgtacccaaccgagcaaccgtgcgaacagcgatggtcaggtctataagtcgtctgcggcattggacagccaggtcatgtatgaggcgtttagcaattttcaggcatttgcggacgatcaaccggaactgtacatgaaccgcgttctggcgaagaacaccgatctgctgaaagcgtggggcgttactagcgttggcttgccgccacaatacgttagcagcaaagacggcaccttcctggatagcactattgataacggctatgcgttcgatgatcgttacgacatggcgctgagccagaacaacaaatacggttctctggaggacttgctgaacgttctgcgcgctctgcacaaagacggtattcaggcgattgcggactgggtcccggatcaaatctacaatttgccgggtaaagaggttgttaatgcgacgcgtgttaacggttacggttaccatcagcagggctaccagattgttgaccaggcgtacgttgcaaacacccgtacggatggtaccgattatcagggtcgttacggtggtgcttttctggacgaactgaaggcgaagtacccgagcattttcaatcgtgtccagattagcaacggtaaacagctgccaaccaatgagaaaatcacgaaatggtccgcgaaatacttcaatggcacgaacatcctgggccgtggtattaactatgtgctgcgcgacgacaagaccaatcagtatttcaacaccagcgcaaacggccaactgctgccgacgccactgcgcgacaccggtgccatcaccagcacgcaagttttccagcgtcgtggccaagacgtctattttctgcgtgataaccaggttatcaaaaacgagtttgtgcaagatggtaacggtaattggtactacttcggtgccgacggtaaaatgacgaagggtgcacaaaacatcaatagcaaggattactatttcttcgataatggcgtccagctgcgtaatgcgctgcgtcgcgcgtccaatggttacacctactattatggcctggacggtgccatgatcaagaacgctttcgtcgattttgatgataagcaccaacaggtgcgtgcgtttactacgcagggcacgatggtggtcggtaatttgcactggagcggtcaccacttctattttgaccgcgaaacgggtatccaagccaaagaccgcattgtgcgtaccgatgatggcaagctgcactattatgtcgcacaaaccggcgatatgggccgcaatgtgtttgcgaccgacagccgcacgggcaagcgctattactttgatgcggacggcaacaccgttacgggctcccgtgtcatcgacggcaagacctactacttcaaccaggacggttcggtcggtaccgcgtacagcaatcgtgcggatagcattatctttgagaatggcaaggctcgctatatcactccggctggcgagattggccgttccatttttgtctacaacccggcgaccaaagcgtggaattacttcgacaaggaaggtaaccgtgtcaccggtcgtcagtatattgacggcaatctgtactactttaaagaggacggctcccaagtgaaaggtgcgattgttgaagagaacggtatcaagtactactacgaaccgggcagcggtatcctggcgagcggtcgttatctgcaagtcggtgacgaccaatggatctacttcaaacacgacggtagcctggcgatcggtcaggttcgtgcagacggtggttacttgaaatactttgataagaatggcatccaggtcaagggccaaaccattgtggaggatggtcatacctattactacgatgccgactccggtgctctggtgacctctagcttcgcggagattgctccgaaccagtgggcctacttcaataccgagggccaagccctgaagggcaaatggaccatcaatggtaaagagtactattttgatcagaacggcattcagtataaaggcaaggcagttaaggtcggcagccgttacaaatactatgacgagaatgacggtcaaccggtcactaaccgttttgcccagattgagccgaacgtctgggcgtactttggtgccgatggctacgcagttactggcgaacaggtgattaatggccagcacctgtacttcgatcagtcgggtcgtcaggttaaaggtgcgtacgtcaccgtgaatggtcaacgtcgttactacgacgcaaacacgggtgaatacattccgggtcgttaa

SEQ ID NO: 43 - protein, 1393 aa, Streptococcus sp.
MINGKQYYVNSDGSVRKNFVFEQDGKSYYFDAETGALATKSQDEFSTEPIKAAVDFSSGNQLYKNDNKSLDQLDTFITADAWYRPKSILKDGKTWTASTEADKRPLLMVWWPDKSTQVNYLNYMQNQGLGAGSFSTNSSQESLNLAAKAVQTKIEERIAREGNTNWLRTSIDQFIKTQPGWNSSTENSSYDHLQGGQLLFNNSKGDTGNRTSYANSDYRLLNRTPTNQSGTRKYFKDNSIGGLEFLLANDIDNSNPAVQAEQLNWLHFMMNIGSIMANDPTANFDGLRVDALDNVDADLLQIASDYFKAVYGVDKSEANAIKHLSYLEAWSANDPYYNKDTKGAQLPIDNALRNALTNLLMRDKNTRMQLGDMTAFMNSSLNPRGANDKNGERMANYIFTRAHDTEAQTIIQRIIRDRINPNLFGYNFTRDEIKKAFEIYNADINTAHKTYASYNLPSVYALMLTNKDSVTRVYYGDLYREDGHYMAKKTPYFDAIDTLLRARIKYVAGGQDMEVKKVGNDGLLTSVRYGKGANNSTDWGTTETRTQGMGVILTNNYDFRLGSNETVTMNMGRAHRNQLYRPLLLTTKDGLATYLNDSDVPSNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGRYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQVIKNEFVQDGNGNWYYFGADGKMTKGAQNINSKDYYFFDNGVQLRNALRRASNGYTYYYGLDGAMIKNAFVDFDDKHQQVRAFTTQGTMVVGNLHWSGHHFYFDRETGIQAKDRIVRTDDGKLHYYVAQTGDMGRNVFATDSRTGKRYYFDADGNTVTGSRVIDGKTYYFNQDGSVGTAYSNRADSIIFENGKARYITPAGEIGRSIFVYNPATKAWNYFDKEGNRVTGRQYIDGNLYYFKEDGSQVKGAIVEENGIKYYYEPGSGILASGRYLQVGDDQWIYFKHDGSLAIGQVRADGGYLKYFDKNGIQVKGQTIVEDGHTYYYDADSGALVTSSFAEIAPNQWAYFNTEGQALKGKWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYIPGR

SEQ ID NO: 44 - DNA, 1929 bp, Aspergillus nidulans
atgaagctcagcacatttctctctgctctgggagctcttccccagctgatctcggctgccccgaatgcagtcgctaacaaacccaggcagtcctcggacgaccggcttgtctttgctcacttcatgattggaatcgtcagcaaccgcaattccgcagccgactacgacgatgatatgaaacgtgccaagtctctcggaatcgatgctttcgcgttgaacatcggggttgatccctacaccgaccagcaactcaatctcgcctatcagtccgctgccaacaatgacatgaaagtcttcatatcgttcgatttcaactggtataacaccggccaaggataccaggttgggcagaagatcgcccaatacgcgaacctcccagcgcagcttaaggtcgacggcaaagtctttgtctcctcgtttgcaggggacggtcttgatatcgcggcgatgcgtcaggccgccggacaggacatctactgggctccaaactaccatccagagtacggcactaacctggatggtgtcgatggcttgctcaattggatggcttggcctaatgatggcaacaacaaggcaccgcgtcctggagcctccgtttcggtggaagagggcgatgagatgtatatcagaactggaaaggactacattgctcctgcttctccctggttcttcacccatttcggccctgaagtcccgtacagcaagaactgggtcttccctggagatttgttgtggtatgaccgctggcagcaactgttgaccatgggcccacgattcatcgagatcgtcacctggaacgattacggcgagtcgcactatatcggcccattgagctcacctcacactgatgatggggcatccaagtgggtgaatgacatgccccatgatggatggatggatatgtctaagccgttcatcgccgcgtacaaggacggcgccacctcggttgatgactatatcaccgaagaccttctcgtgtactggtatcgcccggctccccgtgatgtcaactgcgatgccacagatacttgcatggtccccgccaacaatgccagtggcaattacttctatggccgcccgaatggctgggaaacgatggaagacgctgtgttcgtggtcaccaccctgactgagcccgccactgtgacggtcaattctggaggcaatgtcgaggtctttgatgcgcccgctggagccagcgctttcaaggtcccgatgggcgtgggctcgcaggcgttttcgctcagtcgtaacggacaggtcatccagtcggatatcagtcttctgcccatcattgatggctgcgtttgcggactgtacaatttcaatccttacgttgggtctctcccgccgagtcctattgactctctcgagcccgcaggtctctacagtctcacgcaaggccttcatgtacaaacgtgtttgccaacgccttcactcggcaagacaaccccaacaccgcctccaggctggggagctgctccaacgactacaaggacctcgtctacaaccggcacgaccggcacaactacaagaaccacgcggacgaccacgcgcaccacgacgacgagaccaaccaccagtaccagcactagcacaaccaccaggacaacgacaaccaccagaccaaccacaaccacccggacgacgacaaccacaaacccaaccggcggcaccggaaatgtctgcgtcgccggcacaggaccgggcaactatgtcggtctatgcagtttctgctgcaacttcggttactgccctccaggaccatgcacctgtacggcctatggagcgcccgtgccgacgccgccgacgacgggtgtccggggtgtgccgctgccgtggctggagaactataactcgtacctggggctatgcagctttgcttgtgatcacggatactgtccgccgactgcctgccaggttgcttaa

SEQ ID NO: 45 - protein, 642 aa, Aspergillus nidulans
MKLSTFLSALGALPQLISAAPNAVANKPRQSSDDRLVFAHFMIGIVSNRNSAADYDDDMKRAKSLGIDAFALNIGVDPYTDQQLNLAYQSAANNDMKVFISFDFNWYNTGQGYQVGQKIAQYANLPAQLKVDGKVFVSSFAGDGLDIAAMRQAAGQDIYWAPNYHPEYGTNLDGVDGLLNWMAWPNDGNNKAPRPGASVSVEEGDEMYIRTGKDYIAPASPWFFTHFGPEVPYSKNWVFPGDLLWYDRWQQLLTMGPRFIEIVTWNDYGESHYIGPLSSPHTDDGASKWVNDMPHDGWMDMSKPFIAAYKDGATSVDDYITEDLLVYWYRPAPRDVNCDATDTCMVPANNASGNYFYGRPNGWETMEDAVFVVTTLTEPATVTVNSGGNVEVFDAPAGASAFKVPMGVGSQAFSLSRNGQVIQSDISLLPIIDGCVCGLYNFNPYVGSLPPSPIDSLEPAGLYSLTQGLHVQTCLPTPSLGKTTPTPPPGWGAAPTTTRTSSTTGTTGTTTRTTRTTTRTTTTRPTTSTSTSTTTRTTTTTRPTTTTRTTTTTNPTGGTGNVCVAGTGPGNYVGLCSFCCNFGYCPPGPCTCTAYGAPVPTPPTTGVRGVPLPWLENYNSYLGLCSFACDHGYCPPTACQVA

SEQ ID NO: 46 - DNA, 1908 bp, Hypocrea tawa
atgttgggcgtttttcgccgcctcgggctcggctcccttgccgccgcagctctgtcttctctcggcactgccgctcccgccaatgttgctattcggtctctcgaggaacgtgcttcttctgccgaccgtctcgtattctgtcacttcatgattggtattgttggtgaccgtggcagctcggcagactatgatgatgatatgcaacgtgccaaagccgctggcattgacgccttcgctctgaatatcggcgttgacggctataccgaccagcagcttgggtatgcctatgactctgccgatcgtaatggcatgaaagtcttcatttcattcgatttcaattggtggagccccggcaatgcagttggtgttggccagaagattgcgcagtatgccaaccgtcccgcccagctatatgtcgataaccgtccattcgcctcttccttcgctggtgacggtctggatgtaaatgcgttgcgcaatgctgcaggctccaacgtttactttgtgcccaacttccaccctggtcaatcttctccctcaaacattgacggcgccctgaactggatggcctgggataatgatggaaacaacaaggcacccaagcaaggccagacagtcacggtggcagacggcgacaacgcctacaagaattggttaggtggcaagccttacctagcacctgtctcaccttggtttttcacccatttcggccccgaagtttcatattccaagaactgggttttcccaggtggtgctctgatctataaccggtggcaacaggtcttgcagcaaggcttccccatggttgagattgttacatggaatgactacggcgagtctcactacgtcggcccacttaagtctaagcatttcgacgatggcaactccaaatgggtcaatgatatgccccatgatggattcctggatctttcaaagccgttcattgctgcttataagaacagggatactgacatctccaagtatgttcagaatgagcagcttgtctactggtaccgccgcaacttaaaggcactggactgcgacgccaccgacaccacctctaaccgcccggctaataatggaagcggtaattactttatgggacgccctgatggttggcaaaccatggatgatactgtttatgttgccgcacttctcaagactgccggttctgttacggtcacgtctggcggcaccactcaaacgttccagggcaacgccggagccaacctcttccaaatcccagccagcatcggccagcaaaagtttgctctaactcgtaacggtcagaccgtctttagcggaacctcattgatggatatcaccaacgtttgctcttgcggtatctacaacttcaacccatatgtgggtaccattcctgccggcttcgacgaccctcttcaggctgacggtcttttctctttgaccatcggattgcatgtcacgacttgtcaggccaagccatctcttggaaccaatcctcctgtcacttctggccctgtgtcctcgcttccagcttcctccactacccgcgcatcctcgcctcctgtttcttcaactcgcgtctcttccccccctgtctcttcccctccagttacttctcgcacctcttcttctcctccccctccggccagcagcacgccgtcatcgggtcaggtttgcgttgccggaaccgttgctgacggcgagtctggcaactacatcggcctgtgccaattcagctgcaactacggttactgcccaccaggaccgtgcaagtgcaccgcctttggcgctcccatctcgccaccggcaagcaatgggcgcaatggctgccctctaccgggcgaaggagatggttatctgggcctgtgcagtttcagttgtaaccataattactgccccccaacggcatgccaatactgctag

SEQ ID NO: 47 - protein, 635 aa, Hypocrea tawa
MLGVFRRLGLGSLAAAALSSLGTAAPANVAIRSLEERASSADRLVFCHFMIGIVGDRGSSADYDDDMQRAKAAGIDAFALNIGVDGYTDQQLGYAYDSADRNGMKVFISFDFNWWSPGNAVGVGQKIAQYANRPAQLYVDNRPFASSFAGDGLDVNALRNAAGSNVYFVPNFHPGQSSPSNIDGALNWMAWDNDGNNKAPKQGQTVTVADGDNAYKNWLGGKPYLAPVSPWFFTHFGPEVSYSKNWVFPGGALIYNRWQQVLQQGFPMVEIVTWNDYGESHYVGPLKSKHFDDGNSKWVNDMPHDGFLDLSKPFIAAYKNRDTDISKYVQNEQLVYWYRRNLKALDCDATDTTSNRPANNGSGNYFMGRPDGWQTMDDTVYVAALLKTAGSVTVTSGGTTQTFQGNAGANLFQIPASIGQQKFALTRNGQTVFSGTSLMDITNVCSCGIYNFNPYVGTIPAGFDDPLQADGLFSLTIGLHVTTCQAKPSLGTNPPVTSGPVSSLPASSTTRASSPPVSSTRVSSPPVSSPPVTSRTSSSPPPPASSTPSSGQVCVAGTVADGESGNYIGLCQFSCNYGYCPPGPCKCTAFGAPISPPASNGRNGCPLPGEGDGYLGLCSFSCNHNYCPPTACQYC

SEQ ID NO: 48 - DNA, 1884 bp, Trichoderma konilangbra
atgctaggcattctccgccgtctcgcgctcggcgccctcgccgccgcggccctctctcctctcgtcgtcgccgcgcctgccaatgtcgccatccgctccctcgaggaacgggcgagtagcgcagacaggctcgtgttctgccacttcatgattgggatatgcggtgatcgcggctccagcactgattatgacgacgatatgcaaagggccaaggcagcgggcatcgacgcgtttgcgttgaacattggcgtcgatggatacacggaccagcagctcaactttgcgtacgacgccgccgaccgcgccgggatgaaggtgttcatctccttcgacttcaactggtggagccccggcaacgcagtaggcgtcggccagaagattgcccaatacgcgtcgcggcccgcacagctctacgtcgacaaccggccctttgcgtcgtcgtttgccggcgatggccttgacgtgaatgcgctgcgcaacgccgccggaagcaacgtatactttgtgcccaacttccaccccgggcagtcctccccgtcaaccatcgacggggccctcaactggatggcctgggacaatgacggaaacaacaaggcccccaagcccggccgcaacgtcaccgtcgccgacggcgacaactcgtaccgtagctggctgggcggcaagccctacctggcccccgtttcgccctggttcttcacccacttcggccccgaggtttccttcagcaagaactgggtcttcccgggcggctcgctcctctacgaccgctggcaggacgtgctgcrccagggccccgaaatggtcgagatcatcacctggaacgattacggtgagagccactacaccgggcccctcaaaagtcgccactatgacgacggaaactcgaaatggaccaacgacatgccgcacgacggattcctggacctgtcgaaaccgtttatagcggcgtacaagaaccgcgacacgaacgtggcacggtacgtccagtccgaccagctcgtctactggtacagaaggacgctcaaggggctggactgcgacgcgactgacacgacgtcaaaccggcccgcgaacaacgccagcggcaactacttcatgggccggcccgacgggtggcagacgatggacgacaccgtgtacgtggtggcgctrctcacggccgcgggaactgtgacggtgacgtccggcggggccacccagacgttccagggcaccrccggagccaacctgttcgaggtcccggccaacctgggccagcagaagtttgccctgtcccgcaacgggcagaccgtcttcagcagcacatcgctgatggatatcgctaatgtgtgcccgtgcggcctctacaacttcaacccgtatgtcgggactgtcccgcccggttttgacgacccgctgcaggctgatggccttgcgtcgctgacgatcggactgcacgtcacgacctgtcaggccagaccctccctgggaacgaacccgcccatcacttccggccccggctcctcggtgcccgcttcaaccacccgctcgacttctccgcccggttccacgagccgcttctcgtcgaccccggtttcgtcccgctccatctcttcgacgccaccggtcagcacgccgccccctggccaagtatgtgtggccggcacagtcgctgacggccagtcgggcaactatattggcctatgcaacttcagctgcaacttcggctactgtcctcccggcccttgcaagtgcaccgcctttggcgctcccatcaacccaccggcgaccaatgggcgaaacggatgccccttgcctggagaggatgatagttacttgggcctctgcagcttcagttgcaaccataactactgccctccgacggcatgccaatactgctga

SEQ ID NO: 49 - protein, 627 aa, Trichoderma konilangbra
  MISC_FEATURE (263)..(263): X = R or H
  MISC_FEATURE (407)..(407): X = T or A
MLGILRRLALGALAAAALSPLVVAAPANVAIRSLEERASSADRLVFCHFMIGICGDRGSSTDYDDDMQRAKAAGIDAFALNIGVDGYTDQQLNFAYDAADRAGMKVFISFDFNWWSPGNAVGVGQKIAQYASRPAQLYVDNRPFASSFAGDGLDVNALRNAAGSNVYFVPNFHPGQSSPSTIDGALNWMAWDNDGNNKAPKPGRNVTVADGDNSYRSWLGGKPYLAPVSPWFFTHFGPEVSFSKNWVFPGGSLLYDRWQDVLXQGPEMVEIITWNDYGESHYTGPLKSRHYDDGNSKWTNDMPHDGFLDLSKPFIAAYKNRDTNVARYVQSDQLVYWYRRTLKGLDCDATDTTSNRPANNASGNYFMGRPDGWQTMDDTVYVVALLTAAGTVTVTSGGATQTFQGTXGANLFEVPANLGQQKFALSRNGQTVFSSTSLMDIANVCPCGLYNFNPYVGTVPPGFDDPLQADGLASLTIGLHVTTCQARPSLGTNPPITSGPGSSVPASTTRSTSPPGSTSRFSSTPVSSRSISSTPPVSTPPPGQVCVAGTVADGQSGNYIGLCNFSCNFGYCPPGPCKCTAFGAPINPPATNGRNGCPLPGEDDSYLGLCSFSCNHNYCPPTACQYC

SEQ ID NO: 50 - DNA, 1869 bp, Trichoderma reesei
atgtttggtcttgtccgccgactcggggtcggcgcccttgtcgccgcagccctttcctccctcgctgccgccgcgccagccaacgtcgccatccgctccctcgaggaacgggctagcagcgcagatagacttgtgttttgccactttatgattgggatatgtggtgatcgcacctccagtaccgattatgatgatgatatgcagcgagccaaggccgcgggcattgacgcctttgcccttaacattggtgtcgacggatacacggaccagcagctcaactttgcctacgacgccgctgatcgcgccgggatgaaggtgttcatctcctttgacttcaactggtggagccccggcaacgcggcaggcgtcggccagaagattgcccaatatgcgtcgcggcccgcacagctctacgtcgacaaccgtccctttgcatcgtcgtttgccggtgacggccttgacgtgaatacgctgcggaatgcggccggcagcaacgtgtactttgtgcccaacttccaccccgggcagtcgtcgccgtccaccatcgacggggctctgaactggatggcctgggacaacgacggcaacaacaaggcccccaagcccggccaaaacgtcacagtcgccgacggcgacaactcctaccgcagctggctcgccggcaagccctacctcgcccccgtctcgccctggttcttcacccacttcggcccagaggtatcgtacagtaagaactgggtcttccctggcggctccctgtggtacgaccgctggcaggacgtgctgcgccagggcttcgagatggtcgaaatcgtcacctggaacgattacggtgagagccactacacggggcccctggaaagtcgacactatgacgacggaaactcgaaatggaccaacgacatgccgcacgacggcttcctggacctggcgaagccattcattgccgcgtacaagaaccgcgacacggacgtggcgccctacatccagaatgagcagctgatctactggtatcggcggaatctcaaggggctggactgcgacgcgaccgacacgacgtcgaaccgcccggcgaacaacggcagcggcaactacttcatgggtcggcccgacgggtggcagacgatggacgacacggtgtatgtggtggcgctgctcaagagcgcgggcacggtgacggtgacgtcgggcggcgccacgcagacgttccagggcaccgccggcgccaacctgttcgaggtcccagccaaccttgggcagcagaagtttgccctgtcccgcaacgggcagaccgtcttcagcagcacgtcgctgatggatatcaccaatgtgtgcccgtgcggcatctacaacttcaacccgtatgtcgggactgtgcccgctggctttgacgacccgctcgggcccgatggccttgcttctttgacaatcggactgcacgtcacgacttgtcaggccaagccgtcgctggggaccaacccgcccatcacttccggccccggctcctcggtgcccgtttccactccgcccggttccacgacccgcttctcgtcaacgccggtttcatctcgctccagctcgtccacgccgccggttagcacgccgccgcctggccaagtctgtgtcgccggtacggtggctgacggccagtccggcaactatattggcctctgcaacttcagctgcaacttcgggtactgtccccccggaccctgcaagtgcactgcctacggcgctccgatcaacccaccagcaacgaatgggcgaaatgggtgccccttgcctggagaagacgatagttatctgggcctctgcagcttcagctgcaaccacaattactgtccgccaacagcatgccagtactgctga

SEQ ID NO: 51 - protein, 622 aa, Trichoderma reesei
MFGLVRRLGVGALVAAALSSLAAAAPANVAIRSLEERASSADRLVFCHFMIGICGDRTSSTDYDDDMQRAKAAGIDAFALNIGVDGYTDQQLNFAYDAADRAGMKVFISFDFNWWSPGNAAGVGQKIAQYASRPAQLYVDNRPFASSFAGDGLDVNTLRNAAGSNVYFVPNFHPGQSSPSTIDGALNWMAWDNDGNNKAPKPGQNVTVADGDNSYRSWLAGKPYLAPVSPWFFTHFGPEVSYSKNWVFPGGSLWYDRWQDVLRQGFEMVEIVTWNDYGESHYTGPLESRHYDDGNSKWTNDMPHDGFLDLAKPFIAAYKNRDTDVAPYIQNEQLIYWYRRNLKGLDCDATDTTSNRPANNGSGNYFMGRPDGWQTMDDTVYVVALLKSAGTVTVTSGGATQTFQGTAGANLFEVPANLGQQKFALSRNGQTVFSSTSLMDITNVCPCGIYNFNPYVGTVPAGFDDPLGPDGLASLTIGLHVTTCQAKPSLGTNPPITSGPGSSVPVSTPPGSTTRFSSTPVSSRSSSSTPPVSTPPPGQVCVAGTVADGQSGNYIGLCNFSCNFGYCPPGPCKCTAYGAPINPPATNGRNGCPLPGEDDSYLGLCSFSCNHNYCPPTACQYC

SEQ ID NO: 52 - DNA, 4047 bp, Streptococcus oralis
atgatcgacggcaaaaactactacgtacaggatgatggcacggtaaagaagaatttcgcggtagaactgaatggtcgtatcctgtattttgatgcagaaaccggcgctctggttgatagcaacgagtatcagttccaacagggtacgagcagcctgaacaatgaattttctcagaagaacgcattctatggtacgaccgataaggatattgagactgtggatggctacctgaccgcagatagctggtatcgcccgaaattcatcctgaaggatggcaagacgtggaccgcgagcacggaaacggatctgcgtccgctgttgatggcatggtggccggacaagcgtacccaaatcaactatctgaactacatgaaccagcagggtctgggtgcgggtgcgtttgagaacaaagtggagcaggccctgctgacgggtgcaagccaacaggtacaacgcaagatcgaagagaagattggtaaagagggtgataccaagtggctgcgcaccctgatgggtgcgttcgtgaaaacgcaaccaaactggaatatcaaaaccgagtctgaaacgaccggcacgaaaaaggaccatctgcaaggcggtgcactgctgtatacgaacaacgagaaatccccgcacgcggacagcaaatttcgtctgctgaatcgtaccccgaccagccaaaccggcacgccgaagtatttcatcgacaagtctaacggtggctacgaatttctgctggcgaacgattttgacaatagcaatcctgcggtacaagctgagcagctgaattggctgcactacatgatgaactttggcagcattgttgcgaatgatccgaccgcgaatttcgacggcgttcgtgtggatgctgttgataacgtcaatgcggacttgttgcaaattgcaagcgattactttaagagccgttacaaagtcggtgagagcgaagaagaagcgatcaagcacctgtccatcctggaagcatggagcgataacgacccggactacaacaaagataccaagggtgcacagttggcgattgataacaaactgcgcctgagcctgctgtactctttcatgcgtaatctgagcatccgtagcggtgttgaaccgacgattaccaatagcctgaatgaccgttccagcgaaaagaagaacggcgagcgtatggcaaattacatcttcgtgcgtgcccacgatagcgaggtccaaacggtgatcgccgacatcattcgcgaaaacatcaatccgaacaccgacggcctgacgtttacgatggacgagctgaagcaggcattcaagatttacaacgaggacatgcgcaaggcggacaaaaagtatacccagtttaacattcctaccgcacacgcgctgatgctgtctaataaggattctattacccgcgtgtactatggtgatctgtatactgacgatggtcagtacatggagaagaaaagcccgtatcacgatgcgattgacgctctgctgcgtgcacgtattaaatacgtcgcgggtggccaggatatgaaagtgacctatatgggcgtgccgcgtgaagcggataagtggagctataacggcattctgaccagcgtgcgctatggcacgggcgctaacgaagccacggatgagggcactgcggaaacgcgcacgcaaggtatggcagtgattgcgagcaataatccaaatctgaaactgaatgaatgggacaagttgcaagtcaacatgggtgcggcgcataagaatcaatattaccgtccggttctgctgaccactaaggacggtatcagccgttatctgaccgatgaagaagtgcctcagagcctgtggaaaaagacggacgcaaacggtattctgaccttcgacatgaatgatattgctggctacagcaacgtgcaagttagcggttacctggccgtctgggtcccggtcggtgcgaaggcggatcaagatgcgcgcacgaccgcatccaagaagaaaaatgcgtcgggtcaggtgtacgaaagcagcgcggctctggatagccagctgatttacgaaggtttcagcaactttcaagactttgccactcgcgatgatcagtacacgaacaaggtcattgcgaaaaacgtgaatctgttcaaagaatggggtgtgaccagcttcgagctgccgccgcagtacgtgagcagccaagatggcacctttctggacagcattatccaaaacggctatgcatttgaagaccgttacgatatggcgatgagcaagaataacaagtatggtagcctgaaagacctgttgaacgcgctgcgcgcactgcacagcgtcaacattcaagcaatcgccgattgggtgccggaccaaatttacaacttgccgggcaaagaggtggtgaccgcaactcgtgtcaacaactacggcacctaccgtgagggtgctgaaatcaaagaaaagctgtatgtcgccaatagcaagaccaacgaaaccgatttccaaggtaaatacggtggtgcgttcctggatgagctgaaggcgaagtacccggagattttcgagcgtgtccaaatcagcaacggccaaaagatgactaccgatgaaaagatcaccaaatggagcgcgaaatactttaatggcaccaatattctgggtcgtggcgcgtactatgtcctgaaagattgggccagcaatgattacctgacgaaccgtaacggcgagattgttttgccgaagcaactggttaacaagaatagctataccggctttgtcagcgacgcgaacggcacgaagttctattctacctctggctaccaggcgaagaacagcttcattcaagacgaaaacggtaattggtattactttgacaaacgtggttatctggttacgggcgcacacgagattgatggcaagcatgtctacttcctgaaaaacggtatccaactgcgtgacagcatccgtgaggatgagaacggtaatcaatactattacgaccagaccggcgcacaagtgctgaaccgttactacacgacggacggtcagaattggcgctatttcgatgcgaaaggtgttatggcacgcggcctggtaaagattggtgacggccaacagtttttcgatgaaaacggttaccaggtcaagggcaagattgttagcgcaaaagacggcaagctgcgctactttgataaagactctggcaatgctgtcattaatcgtttcgcgcagggtgacaatccgagcgactggtactatttcggtgtggaatttgctaaactgacgggtttgcaaaagatcggccagcagacgctgtattttgaccaagacggtaagcaagtcaaaggtaagatcgtaactctgtcggacaaaagcattcgttacttcgatgccaacagcggtgaaatggcggttggcaagttcgcggaaggtgcaaagaatgagtggtattatttcgataaaaccggcaaagcggttactggtttgcagaaaattggtaagcagaccctgtactttgaccaggacggtaaacaggttaaaggcaaggttgtcacgctggctgataaaagcatccgctacttcgacgcagactccggcgagatggcggtcggtaagtttgcagagggtgcgaagaacgagtggtactattttgatcagactggcaaggccgtgactggtttgcaaaagattgacaagcaaaccttgtacttcgaccaggacggtaaacaagtcaagggtaagattgtgacgttgagcgacaagtcgatccgttactttgatgctaatagcggtgagatggctactaacaaattcgtcgagggctcgcagaatgaatggtactacttcgatcaagcgggtaaggctgttacgggcttgcaacaggtcggtcagcaaactctgtacttcacccaggatggtaagcaagtgaagggtaaggtcgtggacgtgaacggtgtttctcgttatttcgacgcaaactccggtgacatggctcgttctaaatggattcaactggaagatggcagctggatgtatttcgaccgtgacggtcgtggccagaattttggccgtaactaa

SEQ ID NO: 53 - protein, 1348 aa, Streptococcus oralis
MIDGKNYYVQDDGTVKKNFAVELNGRILYFDAETGALVDSNEYQFQQGTSSLNNEFSQKNAFYGTTDKDIETVDGYLTADSWYRPKFILKDGKTWTASTETDLRPLLMAWWPDKRTQINYLNYMNQQGLGAGAFENKVEQALLTGASQQVQRKIEEKIGKEGDTKWLRTLMGAFVKTQPNWNIKTESETTGTKKDHLQGGALLYTNNEKSPHADSKFRLLNRTPTSQTGTPKYFIDKSNGGYEFLLANDFDNSNPAVQAEQLNWLHYMMNFGSIVANDPTANFDGVRVDAVDNVNADLLQIASDYFKSRYKVGESEEEAIKHLSILEAWSDNDPDYNKDTKGAQLAIDNKLRLSLLYSFMRNLSIRSGVEPTITNSLNDRSSEKKNGERMANYIFVRAHDSEVQTVIADIIRENINPNTDGLTFTMDELKQAFKIYNEDMRKADKKYTQFNIPTAHALMLSNKDSITRVYYGDLYTDDGQYMEKKSPYHDAIDALLRARIKYVAGGQDMKVTYMGVPREADKWSYNGILTSVRYGTGANEATDEGTAETRTQGMAVIASNNPNLKLNEWDKLQVNMGAAHKNQYYRPVLLTTKDGISRYLTDEEVPQSLWKKTDANGILTFDMNDIAGYSNVQVSGYLAVWVPVGAKADQDARTTASKKKNASGQVYESSAALDSQLIYEGFSNFQDFATRDDQYTNKVIAKNVNLFKEWGVTSFELPPQYVSSQDGTFLDSIIQNGYAFEDRYDMAMSKNNKYGSLKDLLNALRALHSVNIQAIADWVPDQIYNLPGKEVVTATRVNNYGTYREGAEIKEKLYVANSKTNETDFQGKYGGAFLDELKAKYPEIFERVQISNGQKMTTDEKITKWSAKYFNGTNILGRGAYYVLKDWASNDYLTNRNGEIVLPKQLVNKNSYTGFVSDANGTKFYSTSGYQAKNSFIQDENGNWYYFDKRGYLVTGAHEIDGKHVYFLKNGIQLRDSIREDENGNQYYYDQTGAQVLNRYYTTDGQNWRYFDAKGVMARGLVKIGDGQQFFDENGYQVKGKIVSAKDGKLRYFDKDSGNAVINRFAQGDNPSDWYYFGVEFAKLTGLQKIGQQTLYFDQDGKQVKGKIVTLSDKSIRYFDANSGEMAVGKFAEGAKNEWYYFDKTGKAVTGLQKIGKQTLYFDQDGKQVKGKVVTLADKSIRYFDADSGEMAVGKFAEGAKNEWYYFDQTGKAVTGLQKIDKQTLYFDQDGKQVKGKIVTLSDKSIRYFDANSGEMATNKFVEGSQNEWYYFDQAGKAVTGLQQVGQQTLYFTQDGKQVKGKVVDVNGVSRYFDANSGDMARSKWIQLEDGSWMYFDRDGRGQNFGRN

SEQ ID NO: 54 - DNA, 3864 bp, Streptococcus mutans UA159
atgattgacggcaaatactactacatcggcagcgacggtcagccaaagaagaattttgcgttgacggttaacaataaagtcctgtattttgacaagaacacgggtgcgctgaccgacaccagccaatatcagttcaaacaaggtctgacgaagctgaacaacgactacacccctcacaatcagattgtcaactttgaaaatactagcctggaaactattgataactatgttactgccgactcttggtatcgtccgaaagacattctgaagaacggtaagacgtggaccgcgtcctctgagagcgatctgcgtccgctgctgatgtcctggtggcctgataagcagacccagatcgcatacctgaactacatgaaccaacaaggcttgggcactggcgagaactataccgctgatagctctcaagagagcctgaacctggcggcacaaaccgttcaagtcaaaatcgaaaccaagatcagccaaacgcaacagactcagtggctgcgtgacatcattaactctttcgttaagacgcaaccgaactggaatagccaaaccgagtctgacacgagcgctggtgaaaaagatcatttgcagggcggtgccctgctgtatagcaattcggacaaaaccgcatacgcaaatagcgactatcgtctgctgaaccgtaccccgaccagccagactggtaagccgaaatacttcgaggacaatagcagcggtggttacgacttcctgttggcaaacgatattgataattccaatccggtggtgcaggctgagcagctgaattggctgcattacctgatgaattacggtagcattgtcgcaaatgacccggaagcgaatttcgatggtgtccgtgttgacgcggtggataacgtgaacgcagacctgttgcagatcgcaagcgattatctgaaagcccattatggtgttgataagagcgagaagaatgcgatcaaccacctgagcatcctggaagcgtggtctgacaacgacccacagtataacaaagacaccaaaggtgcccagctgccgatcgacaacaaactgcgtctgtcgttgctgtacgcactgacccgtccgctggagaaggatgcaagcaacaaaaatgagattcgtagcggtctggagccggttattaccaattccctgaataatcgttccgctgagggcaagaactctgaacgcatggcgaattacatcttcatccgtgctcacgattctgaagttcaaacggtgatcgcaaagatcatcaaagcgcagattaacccgaaaacggatggcctgaccttcaccctggatgagctgaaacaggcgttcaaaatctataacgaggatatgcgccaggcgaagaagaagtatacccagagcaatatcccgacggcatacgccctgatgctgagcaataaggactccatcacgcgcctgtattacggtgatatgtacagcgatgatggccaatacatggcgaccaaatccccgtactacgatgcgattgacaccctgctgaaggcgcgcattaagtatgccgctggcggtcaggatatgaagatcacctacgttgagggtgacaaaagccacatggactgggactatacgggtgtcctgacgagcgttcgctacggcacgggcgcaaacgaagcgaccgaccagggcagcgaagctaccaagacgcaaggtatggccgtcatcacttctaacaacccgtccctgaagctgaatcagaacgacaaggtcattgtcaatatgggcaccgctcacaaaaatcaggaataccgtccgttgctgctgaccaccaaagacggtctgaccagctacaccagcgacgccgctgccaagagcctgtaccgtaaaacgaacgataagggcgagttggtgttcgatgcaagcgacattcagggctatctgaatccgcaagtgagcggttacctggctgtttgggtgcctgtgggtgcgagcgacaaccaggatgtgcgtgtcgcggccagcaataaagccaatgcgaccggccaagtctatgaaagcagcagcgcactggatagccaactgatttatgagggtttttccaactttcaggacttcgtcaccaaggattctgattacaccaataaaaagatcgcgcaaaatgtccagctgtttaagagctggggcgtcaccagctttgagatggctccgcaatacgtcagcagcgaggacggcagctttttggacagcattatccagaacggctatgcgttcgaggatcgttacgacctggcgatgagcaaaaacaacaaatacggctcccagcaggacatgatcaacgcggttaaggcgctgcataagagcggtatccaagtgatcgcggactgggtcccggatcaaatctacaatttgccgggtaaagaggtcgtcaccgcgacccgtgtgaacgactacggcgagtatcgcaaggactccgaaatcaaaaacaccctgtacgccgccaacaccaaaagcaacggtaaagattatcaagcaaagtacggtggcgcctttttgagcgagctggccgccaaatatccgagcatctttaaccgcactcagattagcaatggcaagaagatcgacccgtctgaaaagatcaccgcctggaaggccaaatacttcaatggtacgaacattttgggtcgcggcgttggttacgtcttgaaagacaatgccagcgacaagtattttgagctgaagggcaatcagacttatctgccgaagcaaatgacgaataaagaagcctcgactggtttcgttaatgacggcaatggtatgaccttttacagcacgagcggttatcaagcgaagaacagcttcgttcaggacgcaaaaggcaactggtactactttgacaacaatggccacatggtttacggtctgcaacatctgaacggcgaggtgcaatacttcctgagcaatggcgtgcaactgcgtgaatccttcttggaaaatgccgacggcagcaaaaactatttcggtcacctgggcaaccgttatagcaatggttactacagcttcgataatgatagcaaatggcgctatttcgatgcgagcggtgttatggcagtgggtctgaaaactattaacggtaacacccagtatttcgatcaagacggctaccaagtgaagggtgcatggattaccggcagcgatggtaagaagcgttacttcgacgacggtagcggcaatatggcagttaatcgctttgctaacgacaagaatggcgattggtattacctgaatagcgacggtattgcactggtgggtgttcagaccatcaacggcaaaacgtattactttggccaagatggtaaacaaatcaaaggcaaaatcattaccgataatggtaaactgaaatactttctggcgaacagcggtgagctggcgcgtaacatttttgcgaccgacagccagaacaactggtattacttcggctcggatggtgttgcggttacgggttcgcagacgattgcgggtaaaaagttgtactttgcgtccgacggtaaacaggtgaagggtagctttgttacttacaatggtaaagtgcactattaccatgcggacagcggcgaactgcaagtcaaccgtttcgaggcggataaagacggtaattggtactatctggacagcaacggtgaggcactgacgggtagccagcgtatcaatggtcaacgtgtgtttttcacccgcgagggcaaacaggttaagggtgatgtcgcgtatgatgaacgcggcttgctgcgctattacgacaaaaacagcggtaatatggtgtacaacaaggtggtcacgctggcgaacggtcgtcgtattggtattgaccgctggggtattgctcgctattactaa

SEQ ID NO: 55 - protein, 1287 aa, Streptococcus mutans UA159
MIDGKYYYIGSDGQPKKNFALTVNNKVLYFDKNTGALTDTSQYQFKQGLTKLNNDYTPHNQIVNFENTSLETIDNYVTADSWYRPKDILKNGKTWTASSESDLRPLLMSWWPDKQTQIAYLNYMNQQGLGTGENYTADSSQESLNLAAQTVQVKIETKISQTQQTQWLRDIINSFVKTQPNWNSQTESDTSAGEKDHLQGGALLYSNSDKTAYANSDYRLLNRTPTSQTGKPKYFEDNSSGGYDFLLANDIDNSNPVVQAEQLNWLHYLMNYGSIVANDPEANFDGVRVDAVDNVNADLLQIASDYLKAHYGVDKSEKNAINHLSILEAWSDNDPQYNKDTKGAQLPIDNKLRLSLLYALTRPLEKDASNKNEIRSGLEPVITNSLNNRSAEGKNSERMANYIFIRAHDSEVQTVIAKIIKAQINPKTDGLTFTLDELKQAFKIYNEDMRQAKKKYTQSNIPTAYALMLSNKDSITRLYYGDMYSDDGQYMATKSPYYDAIDTLLKARIKYAAGGQDMKITYVEGDKSHMDWDYTGVLTSVRYGTGANEATDQGSEATKTQGMAVITSNNPSLKLNQNDKVIVNMGTAHKNQEYRPLLLTTKDGLTSYTSDAAAKSLYRKTNDKGELVFDASDIQGYLNPQVSGYLAVWVPVGASDNQDVRVAASNKANATGQVYESSSALDSQLIYEGFSNFQDFVTKDSDYTNKKIAQNVQLFKSWGVTSFEMAPQYVSSEDGSFLDSIIQNGYAFEDRYDLAMSKNNKYGSQQDMINAVKALHKSGIQVIADWVPDQIYNLPGKEVVTATRVNDYGEYRKDSEIKNTLYAANTKSNGKDYQAKYGGAFLSELAAKYPSIFNRTQISNGKKIDPSEKITAWKAKYFNGTNILGRGVGYVLKDNASDKYFELKGNQTYLPKQMTNKEASTGFVNDGNGMTFYSTSGYQAKNSFVQDAKGNWYYFDNNGHMVYGLQHLNGEVQYFLSNGVQLRESFLENADGSKNYFGHLGNRYSNGYYSFDNDSKWRYFDASGVMAVGLKTINGNTQYFDQDGYQVKGAWITGSDGKKRYFDDGSGNMAVNRFANDKNGDWYYLNSDGIALVGVQTINGKTYYFGQDGKQIKGKIITDNGKLKYFLANSGELARNIFATDSQNNWYYFGSDGVAVTGSQTIAGKKLYFASDGKQVKGSFVTYNGKVHYYHADSGELQVNRFEADKDGNWYYLDSNGEALTGSQRINGQRVFFTREGKQVKGDVAYDERGLLRYYDKNSGNMVYNKVVTLANGRRIGIDRWGIARYY

SEQ ID NO: 56 - DNA, 4068 bp, Streptococcus gallolyticus ATCC BAA-2069
atgatcgacggcaaatactactatattgacgaggacggtaacgtaaagaagaatttcgcgattacggtggatggtcagttgctgtacttcgacgctgaaacgggtgctctgaccagcacgtccacctatagcttctccgagggcctgactaatctggtcgataacttcagcattaacaaccagtcctacgacagcaccgaagagtcgtttgagctgatcgacggttacctgaccgtcaatacttggtaccgtccgaccaaaattctggaaaacggtgaaacctgggtcgatagcaccgaaacggatttccgtccgctgctgatggcctggtggccggatgttgacacccaaattgactacttgaactacatgagcgattacttcgatctgggtacgacctatagcgctgacgattcccaagcgagcctgaatctggcagctgaggcggttcaggtgaaaattgaacaagaaattacccgtcaagagaacaccgcctggctgcgcgagatcatctctagctttgttaccacccaggataaatggaatatcaataccgagaatgagggcaccgaccatctgcaaggtggtgccctgctgtacgttaacagcgacttgactccgtgggcaaacagcgattatcgcctgctgaaccgcaccccgacgtaccagacgggtgagactaattactttaaagcagatcgtactggtggctacgaatttctgctggcaaatgacgtggataattctaacccggtcgttcaagccgaacagttgaaccagctgtactacttgatgaattggggctctattgtattcggtgatgacgacgccaattttgatggcgtgcgtgttgacgcggtggacaatgtgaacgctgacctgttgcagatttacacgaacctgttcgaagcggcgtatggtgttaacgagtctgaggcgcaggccctggctcacattagcatcctggaagcgtggtcttataacgacccggactacaaccacgacacgaatggcgctgccctggcaatcgacaatggtctgcgtctgagctttctgtactctttgacgcgccctacggacgagcgcagcggtttggagccactgatcacctctgagattggcctgaccgatcgttccgaggactctgcatacggtgacaccatgccgagctatgttttcgtccgtgcacatgacagcgaggttcagaccattattgcgagcattatcgcagaacagatcaacccggaaaccgatggctataccttcaccctggacgagctgaaccaggcgtttgagatttacaacgcggatatgaacagcgtggataaagagtatacgcattacaatatcccggctgcgtatagcctgctgctgaccaacatggaaagcgtcccgcgtgtttactacggtgacctgtatacggataacggtcagtacatggcgactaagagcccgtattatgaccagatcaccaccctgctgcaagcgcgcattcgttacgcggcgggtggccaatctatggctgttacgtactacacccctgcgtcgagcatgtctaccgacaatgcggatagcgtcctgaatgagactggtgtgctgacttctgtgcgttacggctatggcatcatgaccgccgaccaagaggccacggacgactccgttctgacctctggtattgttactattatcagcaacaaccctaatttgcagctggatgattccgaagtgattgcagtccaggttggtgtggcgcacgctggtcagtattatcgtccgctgttgtacccgacggcggatggtctgcaaagctacctgaacgatagcgataccgacattactaagctggtcgatgataatggttatatctactttacggcagatgagattaaaggctacgaaacggttgacatgaatggctacctgagcgtttgggtcccggttggtgcagacgagaatcaggacatccgtgtcagcgcagacaccagcgcgtacaccgagggtgaattgatctatcaagcaaccgcagcgctggatagccaagtgatctacgagggtttcagcaacttccaagatttcgttacctctaacagcgagtacactaacaagctgatcgcggagaacgtcgatctgtttaccagctggggcattacgagctttgagatggcgccacagtatgtgagcaccgatgacggtacttttctggatagcatcattcaaaacggttatgcatttgacgatcgctacgacctggcaatgagccagaataacaagtatggtagcgctgaagatttgcgtaatgccatcaaggccctgcacgctgctggcattcaggtcattgctgactgggtgccggatcaaatctattcgctgccaggcgaagaagtcgttacggcgactcgcgtgaatgactatggcgaagaaaccgaaggcgcgtacattaacaatacgttgtatgtggcgaacagcaaaagcagcggcgaggactaccaggcacagtatggtggtgagttcctggattacttgcaagaaacctacccggaaatgttcgaagttgcgatgattagcacgggtgagccgattgatccgagcaccaagatcaagatttggaaagcagaatactttaatggtacgaacattctgggtaagggcgctggttacgtgctgagcgatgccgcgactggcacgtactttaccgtgactgagaatggcacgtttctgccgaagcagctgaccaccgactccgccattacgggtttctattacgacggtacgggtatgtcttactttagcacctcgggttatcgcgctaaagcgagcttcattgtttacaacggctactactactattttgatgataacggctacatggtcactggcacggtggaaatcaacggtaagacctactatttcctgccgaatggtattcagctgcgtgatgcgatttacgaagacgagaacggtaatcagtactatttcggtccgttgggcaaccagtatttcaacaactattacagctttgacgttgaagaggtggtggacggtgtaacgactacggtaacgaagtggcgtcattttgacgagaacggcgtgatggcgcgtggtttggtcgagattgatggtgtctaccagtattacgatgaaaacggctaccaggtcaaaggtgagctgatcaccgatgctgatggtaatttgcgttatttcaaagaagatagcggtgaaatggttgttagcgattttgtgaagatcggcgataacaactggtactactttgacgaaaacggtattgcagtcacgggtgcccaaaccattgccggccagaacttgtatttcgatgacaacggtgtgcaggcgaaaggtgcctttgtcacgaacgccgatggcacgcgcagctattatgacgcggacagcggtgagaagatcgtggcagatttcttcactacgggcgataatgactggtattatgcagatgaaaatggcaatctggtgactggtagccaaactatcaatggtcaaaacctgtactttgctgaggacggtttgcaggccaagggtgtgtttgttaccgatacggctggtaacattcactattatgatgcgaactctggcgagttggcggttaataccttcgttggtgatggcgacgactggtattactttgatgagaatggcatcgcagttaccggcgcacaagtcattaacggtcaacacctgtatttcgcagacaacggcatccaagtgaaaggtgaaatcgtcaccgacgcaaacggcaaccgctattactacgatgcagattccggcgaaatggcagttaacacctttgtggagattgacggtgtttggtactattttggtgccgatggtatcgcggtgacgggtgcacaagtaattgatggtcagaatttgtactttaacgcagacggtagccaagtcaagggtgacgttgtccgtatcaacggtttgcgttactactacgacgctaatagcggcgaacaggtgcgcaatcagtgggtcacgctgccggatggtactgttgttttctttaatgcgcgtggctatacttggggctaa

SEQ ID NO: 57 - protein, 1355 aa, Streptococcus gallolyticus ATCC BAA-2069
MIDGKYYYIDEDGNVKKNFAITVDGQLLYFDAETGALTSTSTYSFSEGLTNLVDNFSINNQSYDSTEESFELIDGYLTVNTWYRPTKILENGETWVDSTETDFRPLLMAWWPDVDTQIDYLNYMSDYFDLGTTYSADDSQASLNLAAEAVQVKIEQEITRQENTAWLREIISSFVTTQDKWNINTENEGTDHLQGGALLYVNSDLTPWANSDYRLLNRTPTYQTGETNYFKADRTGGYEFLLANDVDNSNPVVQAEQLNQLYYLMNWGSIVFGDDDANFDGVRVDAVDNVNADLLQIYTNLFEAAYGVNESEAQALAHISILEAWSYNDPDYNHDTNGAALAIDNGLRLSFLYSLTRPTDERSGLEPLITSEIGLTDRSEDSAYGDTMPSYVFVRAHDSEVQTIIASIIAEQINPETDGYTFTLDELNQAFEIYNADMNSVDKEYTHYNIPAAYSLLLTNMESVPRVYYGDLYTDNGQYMATKSPYYDQITTLLQARIRYAAGGQSMAVTYYTPASSMSTDNADSVLNETGVLTSVRYGYGIMTADQEATDDSVLTSGIVTIISNNPNLQLDDSEVIAVQVGVAHAGQYYRPLLYPTADGLQSYLNDSDTDITKLVDDNGYIYFTADEIKGYETVDMNGYLSVWVPVGADENQDIRVSADTSAYTEGELIYQATAALDSQVIYEGFSNFQDFVTSNSEYTNKLIAENVDLFTSWGITSFEMAPQYVSTDDGTFLDSIIQNGYAFDDRYDLAMSQNNKYGSAEDLRNAIKALHAAGIQVIADWVPDQIYSLPGEEVVTATRVNDYGEETEGAYINNTLYVANSKSSGEDYQAQYGGEFLDYLQETYPEMFEVAMISTGEPIDPSTKIKIWKAEYFNGTNILGKGAGYVLSDAATGTYFTVTENGTFLPKQLTTDSAITGFYYDGTGMSYFSTSGYRAKASFIVYNGYYYYFDDNGYMVTGTVEINGKTYYFLPNGIQLRDAIYEDENGNQYYFGPLGNQYFNNYYSFDVEEVVDGVTTTVTKWRHFDENGVMARGLVEIDGVYQYYDENGYQVKGELITDADGNLRYFKEDSGEMVVSDFVKIGDNNWYYFDENGIAVTGAQTIAGQNLYFDDNGVQAKGAFVTNADGTRSYYDADSGEKIVADFFTTGDNDWYYADENGNLVTGSQTINGQNLYFAEDGLQAKGVFVTDTAGNIHYYDANSGELAVNTFVGDGDDWYYFDENGIAVTGAQVINGQHLYFADNGIQVKGEIVTDANGNRYYYDADSGEMAVNTFVEIDGVWYYFGADGIAVTGAQVIDGQNLYFNADGSQVKGDVVRINGLRYYYDANSGEQVRNQWVTLPDGTVVFFNARGYTWG

SEQ ID NO: 58 - protein, 1772 aa, Lactococcus reuteri
MEIKKHFKLYKSGKQWVTAAVATVAVSTALLYGGVAHADQQVQSSTTQEQTSTVNADTTKTVNLDTNTDQPAQTTDKNQVANDTTTNQSKTDSTSTTVKNPTFIPVSTLSSSDNEKQSQNYNKPDNGNYGNVDAAYFNNNQLHISGWHATNASQGTDSRQVIVRDITTKTELGRTNVTNNVLRPDVKNVHNVYNADNSGFDVNINIDFSKMKDYRDSIEIVSRYSGNGKSVDWWSQPITFDKNNYAYLDTFEVKNGELHATGWNATNKAINYNHHFVILFDRTNGKEVTRQEVRDGQSRPDVAKVYPQVVGANNSGFDVTFNIGDLDYTHQYQILSRYSNADNGEGDYVTYWFAPQSIAPANQSNQGYLDSFDISKNGEVTVTGWNATDLSELQTNHYVILFDQTAGQQVASAKVDLISRPDVAKAYPTVKTAETSGFKVTFKVSNLQPGHQYSVVSRFSADENGNGNDKRHTDYWYSPVTLNQTASNIDTITMTSNGLHITGWMASDNSINEATPYAIILNNGREVTRQKLTLIARPDVAAVYPSLYNSAVSGFDTTIKLTNAQYQALNGQLQVLLRFSKAVDGNPNGTNTVTDQFSKNYATTGGNFDYVKVNGNQIEFSGWHATNQSNDKNSQWIIVLVNGKEVKRQLVNDTKDGAAGFNRNDVYKVNPAIENSIMSGFQGIITLPVTVKDENVQLVHRFSNDAKTGEGNYVDFWSEVMSVKDSFQKGNGPLNQFGLQTINGQQYYIDPTTGQPRKNFLLQNGNDWIYFDKDTGAGTNALKLQFDKGTISADEQYRRGNEAYSYDDKSIENVNGYLTADTWYRPKQILKDGTTWTDSKETDMRPILMVWWPNTVTQAYYLNYMKQYGNLLPASLPSFSTDADSAELNHYSELVQQNIEKRISETGSTDWLRTLMHEFVTKNSMWNKDSENVDYGGLQLQGGFLKYVNSDLTKYANSDWRLMNRTATNIDGKNYGGAEFLLANDIDNSNPVVQAEELNWLYYLMNFGTITGNNPEANFDGIRVDAVDNVDVDLLSIARDYFNAAYNMEQSDASANKHINILEDWGWDDPAYVNKIGNPQLTMDDRLRNAIMDTLSGAPDKNQALNKLITQSLVNRANDNTENAVIPSYNFVRAHDSNAQDQIRQAIQAATGKPYGEFNLDDEKKGMEAYINDQNSTNKKWNLYNMPSAYTILLTNKDSVPRVYYGDLYQDGGQYMEHKTRYFDTITNLLKTRVKYVAGGQTMSVDKNGILTNVRFGKGAMNATDTGTDETRTEGIGVVISNNTNLKLNDGESVVLHMGAAHKNQKYRAVILTTEDGVKNYTNDTDAPVAYTDANGDLHFTNTNLDGQQYTAVRGYANPDVTGYLAVWVPAGAADDQDARTAPSDEAHTTKTAYRSNAALDSNVIYEGFSNFIYWPTTESERTNVRIAQNADLFKSWGITTFELAPQYNSSKDGTFLDSIIDNGYAFTDRYDLGMSTPNKYGSDEDLRNALQALHKAGLQAIADWVPDQIYNLPGKEAVTVTRSDDHGTTWEVSPIKNVVYITNTIGGGEYQKKYGGEFLDTLQKEYPQLFSQVYPVTQTTIDPSVKIKEWSAKYFNGTNILHRGAGYVLRSNDGKYYNLGTSTQQFLPSQLSVQDNEGYGFVKEGNNYHYYDENKQMVKDAFIQDSVGNWYYFDKNGNMVANQSPVEISSNGASGTYLFLNNGTSFRSGLVKTDAGTYYYDGDGRMVRNQTVSDGAMTYVLDENGKLVSESFDSSATEAHPLKPGDLNGQK

SEQ ID NO: 59 - DNA, 5208 bp, Lactobacillus reuteri
atggatcagcaagtacaaagcagcaccacccaggagcagacgagcacggttaacgcggacacgactaaaaccgtcaatctggataccaacactgaccagccggctcagacgaccgataagaatcaggtcgcgaatgataccaccaccaaccaaagcaagacggacagcaccagcacgacggttaagaatccgacgtttattcctgttagcactttgtccagctccgataacgaaaagcagagccagaattacaataaaccagataacggtaattacggtaatgttgatgcggcctacttcaataacaatcagctgcacattagcggttggcacgcaaccaacgcgagccagggtacggatagccgccaagtaatcgtacgcgacattaccaccaagaccgagctgggtcgtactaatgtgaccaacaatgttctgcgtccggacgtgaaaaatgttcacaacgtctacaacgctgacaacagcggctttgatgtgaatatcaatattgatttcagcaagatgaaagactatcgtgacagcatcgagatcgtttctcgttatagcggcaacggcaagagcgttgactggtggtcgcagccgatcacgtttgacaaaaacaattatgcttatctggacactttcgaggtgaagaacggtgaactgcatgcaacgggctggaatgccaccaacaaggctatcaattacaatcaccacttcgttattctgtttgatcgtacgaatggcaaagaagtcacccgccaagaggtgcgtgatggtcaaagccgtccggatgtggcgaaggtatacccgcaagtcgttggcgcgaacaatagcggttttgacgttacgtttaacattggtgatttggactacacccatcagtaccagatcctgtctcgttacagcaacgcagacaacggtgaaggcgattatgtgacctattggtttgcgccgcagagcatcgctccggcgaatcaaagcaaccaaggttacctggacagcttcgatatttcgaaaaacggtgaggtgaccgtgacgggttggaatgcgacggatctgagcgagttgcaaacgaatcactacgtgatcctgtttgatcagacggcgggtcaacaggttgcatccgctaaggtcgacctgatcagccgtccagacgtcgcgaaggcgtaccctaccgttaaaacggcagaaacctccggtttcaaggtcacgtttaaggttagcaatctgcaaccgggccaccaatacagcgtcgttagccgctttagcgccgatgaaaacggtaatggcaacgacaaacgccacacggactactggtactctccggttaccctgaaccaaacggctagcaacattgacactatcaccatgacttccaacggtctgcacatcaccggctggatggcgagcgataatagcattaacgaagcgaccccgtacgcgattatcctgaacaacggtcgcgaggtgacgcgccagaaactgaccctgatcgcgcgtccggatgttgcggcagtgtatccgagcctgtacaatagcgcggttagcggcttcgacaccaccatcaagctgactaacgcgcaatatcaagcattgaacggccagctgcaagtgctgctgcgctttagcaaggcggtggacggtaacccgaatggtaccaataccgtcacggatcaatttagcaaaaactacgcaacgaccggtggtaatttcgattacgtcaaggttaatggtaaccaaattgagttttctggctggcacgcgacgaatcagagcaatgataagaacagccaatggattatcgtcttggttaacggtaaagaggtcaaacgccagctggtcaatgacacgaaagacggcgcagccggcttcaatcgtaatgatgtgtataaagtgaacccagcgatcgaaaatagcattatgtctggcttccagggcattatcacgttgccggttacggtgaaagacgaaaacgtgcagctggtgcaccgcttctccaatgacgcaaaaacgggtgagggcaattatgtcgatttctggagcgaggtgatgtctgtgaaggactctttccaaaagggtaatggtccgctgaaccagtttggcctgcaaaccatcaacggccaacaatactatattgacccgacgaccggccagccgcgtaagaatttcctgctgcaaaacggcaacgattggatttacttcgacaaagacactggcgcaggcaccaacgcgctgaaattgcagtttgataagggcacgattagcgctgacgaacaataccgtcgcggcaacgaggcgtactcctacgatgataagagcattgaaaatgtcaacggttacttgacggcggacacgtggtaccgcccgaagcagatcctgaaggatggcaccacttggaccgattccaaagaaaccgatatgcgtccgatcttgatggtctggtggccaaacacggtgactcaggcgtactatctgaactacatgaaacaatatggcaatctgctgccggcgagcctgccgagctttagcaccgacgccgatagcgcggagttgaatcattattccgagctggtccaacagaatatcgagaaacgtattagcgagactggtagcactgattggctgcgtaccctgatgcacgagttcgtgacgaagaatagcatgtggaacaaagatagcgagaacgttgactacggtggcctgcaactgcaaggtggtttcctgaagtacgttaacagcgacctgacgaagtacgcaaactctgattggcgtctgatgaaccgtaccgcgacgaacattgacggtaagaattacggtggtgccgagtttctgctggcgaatgacatcgacaactctaacccggtggtgcaggccgaagaattgaattggctgtattatctgatgaacttcggtaccatcaccggtaacaacccagaagctaacttcgacggcatccgtgtcgacgcggtcgataatgtggatgttgatctgctgagcattgcccgtgactactttaatgcagcgtataacatggaacaaagcgatgctagcgcgaataagcacatcaatattctggaagattggggctgggacgatccggcgtacgtgaacaaaatcggcaatccacagttgaccatggatgaccgcctgcgtaatgcaattatggacaccctgagcggtgcgccggataagaaccaagcgctgaacaagctgattactcagtctctggtgaatcgcgcaaatgataatactgaaaacgcggtgatcccttcctacaactttgtccgcgctcatgacagcaatgcccaggaccagatccgtcaagcgatccaggcggcaaccggcaaaccttatggcgagttcaacttggatgatgagaaaaagggtatggaggcttacatcaatgaccaaaatagcaccaataagaaatggaacctgtacaacatgccgagcgcatataccatcctgctgacgaataaggactcggtcccgcgtgtctactatggcgacttgtaccaggatggtggccagtacatggaacacaaaactcgttactttgacaccatcacgaatctgctgaaaacccgcgtcaagtatgtcgcaggcggccagaccatgtctgtggataagaatggcattttgactaatgtccgtttcggtaagggtgcgatgaacgcaactgacacgggtaccgatgaaacccgcaccgaaggtatcggcgttgttatcagcaacaatacgaatttgaaactgaatgacggcgaaagcgttgtgctgcacatgggcgctgcccataagaatcagaagtatcgtgcagtgatcctgaccacggaggacggtgtgaagaattacaccaacgacaccgatgcgccggtcgcatacaccgacgcgaacggcgatttgcatttcaccaatactaacctggacggtcagcaatataccgccgttcgtggctacgcaaacccggacgttacgggttatctggccgtctgggttcctgctggtgccgccgatgaccaagacgcacgtaccgctccgagcgacgaggcccacaccacgaaaacggcgtatcgttccaatgcggcattggactccaacgtcatctacgaaggcttttcgaactttatctattggccgacgaccgagagcgagcgcacgaatgtccgcatcgcgcagaacgcggatctgttcaaatcgtggggtatcaccaccttcgagctggcgccacagtacaatagcagcaaggacggtacgtttctggattcgatcattgacaatggttacgcgtttaccgatcgttatgacctgggtatgtctaccccgaacaagtacggtagcgatgaggatctgcgtaacgccctgcaagcactgcacaaggccggtctgcaagccatcgcagattgggttccggaccaaatctacaatctgccgggcaaagaggctgtcacggttactcgtagcgatgaccacggcactacctgggaggttagcccgatcaagaatgtggtgtatatcactaataccatcggtggtggcgaataccagaaaaagtatggtggtgaatttctggacaccttgcaaaaagaatatccgcagctgtttagccaagtttacccggtgacccaaacgacgattgaccctagcgttaagattaaagagtggtccgcgaagtacttcaatggtactaatatcctgcatcgcggtgcgggttacgtcctgcgtagcaatgatggtaagtattacaacctgggtactagcacccagcagttcctgccgagccagctgagcgttcaagataatgagggttacggtttcgttaaagagggtaacaactatcactattatgacgagaacaaacaaatggttaaggacgcgtttatccaggatagcgtcggcaattggtactattttgataagaacggcaatatggttgcaaaccaaagcccggttgaaatcagcagcaacggtgcgagcggcacctacttgtttttgaataatggtaccagcttccgcagcggcctggtcaaaacggatgcaggcacctattactacgatggtgacggtcgcatggttcgtaatcaaacggtttctgacggtgccatgacgtacgttctggacgaaaatggtaaactggtcagcgaatcttttgatagcagcgcgaccgaggcccatccgctgaaaccgggcgatctgaacggtcaaaagtaa

SEQ ID NO: 60 - protein, 1735 aa, Lactobacillus reuteri
MDQQVQSSTTQEQTSTVNADTTKTVNLDTNTDQPAQTTDKNQVANDTTTNQSKTDSTSTTVKNPTFIPVSTLSSSDNEKQSQNYNKPDNGNYGNVDAAYFNNNQLHISGWHATNASQGTDSRQVIVRDITTKTELGRTNVTNNVLRPDVKNVHNVYNADNSGFDVNINIDFSKMKDYRDSIEIVSRYSGNGKSVDWWSQPITFDKNNYAYLDTFEVKNGELHATGWNATNKAINYNHHFVILFDRTNGKEVTRQEVRDGQSRPDVAKVYPQVVGANNSGFDVTFNIGDLDYTHQYQILSRYSNADNGEGDYVTYWFAPQSIAPANQSNQGYLDSFDISKNGEVTVTGWNATDLSELQTNHYVILFDQTAGQQVASAKVDLISRPDVAKAYPTVKTAETSGFKVTFKVSNLQPGHQYSVVSRFSADENGNGNDKRHTDYWYSPVTLNQTASNIDTITMTSNGLHITGWMASDNSINEATPYAIILNNGREVTRQKLTLIARPDVAAVYPSLYNSAVSGFDTTIKLTNAQYQALNGQLQVLLRFSKAVDGNPNGTNTVTDQFSKNYATTGGNFDYVKVNGNQIEFSGWHATNQSNDKNSQWIIVLVNGKEVKRQLVNDTKDGAAGFNRNDVYKVNPAIENSIMSGFQGIITLPVTVKDENVQLVHRFSNDAKTGEGNYVDFWSEVMSVKDSFQKGNGPLNQFGLQTINGQQYYIDPTTGQPRKNFLLQNGNDWIYFDKDTGAGTNALKLQFDKGTISADEQYRRGNEAYSYDDKSIENVNGYLTADTWYRPKQILKDGTTWTDSKETDMRPILMVWWPNTVTQAYYLNYMKQYGNLLPASLPSFSTDADSAELNHYSELVQQNIEKRISETGSTDWLRTLMHEFVTKNSMWNKDSENVDYGGLQLQGGFLKYVNSDLTKYANSDWRLMNRTATNIDGKNYGGAEFLLANDIDNSNPVVQAEELNWLYYLMNFGTITGNNPEANFDGIRVDAVDNVDVDLLSIARDYFNAAYNMEQSDASANKHINILEDWGWDDPAYVNKIGNPQLTMDDRLRNAIMDTLSGAPDKNQALNKLITQSLVNRANDNTENAVIPSYNFVRAHDSNAQDQIRQAIQAATGKPYGEFNLDDEKKGMEAYINDQNSTNKKWNLYNMPSAYTILLTNKDSVPRVYYGDLYQDGGQYMEHKTRYFDTITNLLKTRVKYVAGGQTMSVDKNGILTNVRFGKGAMNATDTGTDETRTEGIGVVISNNTNLKLNDGESVVLHMGAAHKNQKYRAVILTTEDGVKNYTNDTDAPVAYTDANGDLHFTNTNLDGQQYTAVRGYANPDVTGYLAVWVPAGAADDQDARTAPSDEAHTTKTAYRSNAALDSNVIYEGFSNFIYWPTTESERTNVRIAQNADLFKSWGITTFELAPQYNSSKDGTFLDSIIDNGYAFTDRYDLGMSTPNKYGSDEDLRNALQALHKAGLQAIADWVPDQIYNLPGKEAVTVTRSDDHGTTWEVSPIKNVVYITNTIGGGEYQKKYGGEFLDTLQKEYPQLFSQVYPVTQTTIDPSVKIKEWSAKYFNGTNILHRGAGYVLRSNDGKYYNLGTSTQQFLPSQLSVQDNEGYGFVKEGNNYHYYDENKQMVKDAFIQDSVGNWYYFDKNGNMVANQSPVEISSNGASGTYLFLNNGTSFRSGLVKTDAGTYYYDGDGRMVRNQTVSDGAMTYVLDENGKLVSESFDSSATEAHPLKPGDLNGQK

SEQ ID NO: 61 - protein, 1574 aa, Streptococcus gordonii
MRSKKLWISLLFALTLIFTMAFSNMSAQAAGKLESGVIYADDANQVTNVKEQSAVQSKDSEQTTSDKATDSSQLEVKEQASSSKETYQASAATNPTANEQTTQQDKEVETSRTDSRHELTQKTSDDSSEKSGSSQEPKVADQAESTDKTQAALQAKQDSRANDQEETTENVAKATVSDKIIATPKKERLPEPAQRKESITEKMLAAQAQAAPVNTEHDDDVLAHIKTIDGKKYYVQDDGTVKKNFAVELNGKILYFDAETGALVDSNEYQFQQGTSSLNNEFTQKNAFYGTTDKDIETVDGYLTADSWYRPKFILKDGKTWTASTETDLRPLLMAWWPDKRTQINYLNYMNQENLGIGAFESKTEQVLLTNAVQQVQRKIEERISKEGDTKWLRTLMSAFVKTQPNWNIKTESETTGTNKDHLQGGALLYTNSDKTSHANSRYRLLNRTPTSQTGTPKYFIDKSNGGYEFLLANDFDNSNPAVQAEQLNWLHYMMNFGSIVANDPTANFDGVRVDAVDNVNADLLQIASDYFKSRYKVGESEEEALKHLSILEAWSDNDPDYNKDTKGAQLAIDNKLRLSLLYSFMRKLSIRSGVEPTITNSLNDRSTENKNGERTANYIFVRAHDSEVQTVIADIIRENINPNTDGLTFTMDELKQAFKIYNEDMRKADKKYTQFNIPTAHALMLSNKDSITRVYYGDLYTDDGQYMEKKSPYHDAIDALLRARIKYVAGGQDMKVTYMGVPREADKWSYNGILTSVRYGTGANEATDEGTAETRTQGMAVIASNNPNLKLNEWDKLQVNMGAAHKNQYYRPVLLTTKDGISRYLTDEEVPQSLWKKTDANGILTFDMNDIAGYSNVQVSGYLAVWVPVGAKENQDARVTASKKKNASGQVYESSPALDSQLIYEGFSNFQDFATRDDQYTNKVIAKNVNLFKEWGVTSFELPPQYVSSQDGTFLDSIIQNGYAFEDRYDMAMSKNNKYGSLDDLLNALRALHSVNIQAIADWVPDQIYNLPGKEVVTATRVNNYGTYREGAEIKEKLYVANSKTNGTDYQGKYGGAFLDELKAKYPEIFERVQISNGQKMTTDEKITKWSAKYFNGTNILGRGAYYVLKDWGSKEYLSNKNGETALPKQLVNKEASTGFVKDTNGFKFYSTSGNQAKDTFIQDENGNWYYFDNQGYLVTGAREIDGKQLYFMKNGVQLRDALQEDENGNQYYYDKTGAKVLNRYYTSDGQNWRYFDAKGVMARGLVKIGDGQQYFDQNGYQVKGKVVRAKDGKLRYFDKDSGNAVINRFAQGDNPSDWYYFGADGVALTGLQKIGQQTLYFGQDGKQVKGQVVMLADKSIRYFDANSGEMAVNKFAEGAKNEWYYFDQDGKAVTGLKTINNQVLYFDQDGKQVKGQVVTLADKSIRYFDANSGEMAVNKFAEGAKNEWYYFDQDGKAVTGLQTINKQVLYFGQDGKQVKGQVVTLADKSIRYFDANSGEMAVNKFAEGAKNEWYYFDQDGKAVTGLKTINNQVLYFGQDGKQVKGQVVYVDGAERYFDPKSGDMVRNKWIRLEDGTWMYFDRNGRGRRFGRN

SEQ ID NO: 62 - protein, 1597 aa, Streptococcus downei
MEKNERFKMHKVKKRWVTISVASATMLASALGASVASADTETVSEDSNQAVLTADQTTTNQDTEQTSVAATATSEQSASTDAATDQASATDQASAAEQTQGTTASTDTAAQTTTNANEAKWVPTENENQVFTDEMLAEAKNVATAESNSIPSDLAKMSNVKQVDGKYYYYDQDGNVKKNFAVSVGEKIYYFDETGAYKDTSKVEADKSGSDISKEETTFAANNRAYSTSAENFEAIDNYLTADSWYRPKSILKDGKTWTESSKDDFRPLLMAWWPDTETKRNYVNYMNKVVGIDKTYTAETSQADLTAAAELVQARIEQKITTEQNTKWLREAISAFVKTQPQWNGESEKPYDDHLQNGALKFDNQSDLTPDTQSNYRLLNRTPTNQTGSLDSRFTYNANDPLGGYELLLANDVDNSNPIVQAEQLNWLHYLLNFGTIYAKDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDLIRDIIKAEINPNAFGYSFTQDEIDQAFKIYNEDLKKTDKKYTHYNVPLSYTLLLTNKGSIPRVYYGDMFTDDGQYMANKTVNYDAIESLLKARMKYVAGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQASNKYLNVSDDKLFLPKTLLGQVVESGIRFDGTGYVYNSSTTGEKVTDSFITEAGNLYYFGQDGYMVTGAQNIKGSNYYFLANGAALRNTVYTDAQGQNHYYGNDGKRYENGYQQFGNDSWRYFKNGVMALGLTTVDGHVQYFDKDGVQAKDKIIVTRDGKVRYFDQHNGNAVTNTFVADKTGHWYYLGKDGVAVTGAQTVGKQHLYFEANGQQVKGDFVTAKDGKLYFYDVDSGDMWTNTFIEDKAGNWFYLGKDGAAVTGAQTIKGQKLYFKANGQQVKGDIVKDADGKIRYYDAQTGEQVFNKSVSVNGKTYYFGSDGTAQTQANPKGQTFKDGSGVLRFYNLEGQYVSGSGWYETAEHEWVYVKSGKVLTGAQTIGNQRVYFKDNGHQVKGQLVTGNDGKLRYYDANSGDQAFNKSVTVNGKTYYFGSDGTAQTQANPKGQTFKDGSGVLRFYNLEGQYVSGSGWYKNAQGQWLYVKDGKVLTGLQTVGNQKVYFDKNGIQAKGKAVRTSDGKVRYFDENSGSMITNQWKFVYGQYYYFGSDGAAVYRGWN

SEQ ID NO: 63 - DNA, 4311 bp, Streptococcus downei
atggttgacggcaaatactactactacgatcaggacggcaacgtaaagaaaaacttcgcggttagcgtgggcgagaaaatctattactttgacgaaactggcgcctacaaagacaccagcaaagttgaggcggacaaaagcggcagcgacattagcaaggaagagactaccttcgcggcaaacaaccgcgcctacagcaccagcgcggagaattttgaggcgatcgacaattatctgaccgcggactcctggtatcgtcctaaatccatcctgaaggatggcaaaacgtggacggaaagcagcaaagatgactttcgtccgctgctgatggcgtggtggccggataccgaaacgaagcgcaattacgtgaactacatgaacaaagttgttggcatcgacaagacctataccgcggaaaccagccaggccgacttgaccgctgcggcggaactggtgcaagcacgcattgagcagaagatcacgaccgaacagaacacgaaatggctgcgtgaggcaatctcggcatttgttaaaacgcaaccgcagtggaacggtgaaagcgagaagccgtacgacgatcacctgcaaaacggtgctctgaaatttgataatcagagcgacctgaccccggatacgcaaagcaactaccgtctgttgaaccgtaccccgactaatcagacgggtagcctggacagccgcttcacttataacgcgaacgaccctttgggcggttatgagctgctgctggcaaatgacgtcgataacagcaatccgatcgtgcaggcggagcagctgaactggctgcattacctgctgaattttggtacgatctacgccaaagatgccgacgctaacttcgatagcattcgtgtggacgcggttgataacgtcgatgcggatctgctgcaaattagcagcgattacctgaaagcagcctacggcattgataagaataacaaaaacgcgaacaaccacgtgagcattgtcgaagcctggagcgataatgataccccgtacctgcatgacgatggtgacaacctgatgaatatggataacaaatttcgcctgtccatgctgtggtcgctggccaaaccgctggacaagcgtagcggtctgaacccgctgattcataacagcttggtggatcgtgaagttgatgaccgcgaggttgaaacggttccgagctattcttttgcacgtgcgcatgatagcgaggtccaggacttgatccgtgacatcatcaaggcagagatcaatccgaacgcattcggttatagctttacccaagacgagattgaccaggcctttaagatttacaatgaggatctgaagaaaacggataagaaatacacccactataatgtgccgttgagctacaccctgctgctgacgaataagggtagcatcccacgtgtctactatggtgatatgtttaccgacgatggtcagtatatggcgaacaaaaccgtcaactatgacgccattgaatctctgctgaaagcgcgtatgaagtatgtcgctggcggtcaagcaatgcagaactaccaaatcggtaatggtgagatcctgaccagcgttcgttatggtaagggtgccctgaaacagagcgacaaaggtgatgcgaccacgcgcaccagcggtgtcggtgtcgttatgggcaatcagccaaactttagcttggacggcaaagtggtggctctgaacatgggcgcagctcatgcgaatcaggagtatcgtgcgctgatggttagcacgaaagacggtgttgccacgtatgcgaccgatgcagatgcgagcaaagccggtctggtcaaacgtaccgacgaaaacggctacctgtatttcctgaatgacgacctgaagggtgtggccaatcctcaggtgagcggtttcttgcaggtgtgggttccggtgggtgccgcggatgatcaagatatccgtgttgcagctagcgataccgcatccaccgatggcaagagcctgcaccaagacgccgcgatggatagccgtgttatgtttgaaggcttctctaactttcagtcctttgccacgaaagaagaggaatataccaacgtcgttatcgccaacaatgtggataagttcgttagctggggtatcacggatttcgagatggccccacaatatgtttccagcaccgacggtcaattcctggactctgtcattcagaacggttatgcttttacggaccgttatgacttgggcatgtctaaggcaaacaaatacggcacggccgatcaactggttaaggccattaaggccctgcacgcgaagggcctgaaggttatggcagattgggtgccggatcagatgtataccttcccgaaacaggaagtcgtgaccgttacccgtaccgacaaatttggcaaaccgatcgcaggttcccaaatcaatcatagcctgtatgttaccgataccaagtccagcggcgatgactatcaggccaaatatggtggtgcgtttctggacgagctgaaggagaaatatccggagctgttcacgaagaaacaaatcagcacgggtcaagctattgacccgagcgtgaaaatcaaacagtggtctgctaagtatttcaatggctccaacatcctgggtcgcggtgcggactacgtactgtcggatcaggcgagcaacaaatacctgaacgtgtctgacgataaactgttcctgccgaaaaccttgctgggccaagttgtcgagagcggtatccgctttgacggcactggttatgtgtacaactctagcactacgggtgaaaaagttaccgattccttcattacggaggcaggtaatctgtactacttcggtcaagacggctatatggtgaccggcgcacagaacattaagggcagcaactattacttcctggccaatggtgcggccctgcgtaacaccgtttacaccgatgcgcaaggtcagaatcactattacggcaacgacggcaagcgttatgagaatggttaccaacagttcggcaacgattcttggcgttacttcaaaaatggcgtgatggcgctgggtctgactacggtggatggtcacgtgcagtatttcgataaagatggtgtccaggccaaggataagatcattgtcacccgcgatggcaaagtccgctatttcgaccagcacaacggtaatgcggttactaacacgttcgttgcggacaagacgggtcactggtactatctgggcaaagacggcgtcgcggttaccggtgcgcagactgtgggtaaacagcatttgtactttgaagcgaacggtcaacaagtcaagggtgacttcgtgacggctaaagacggtaaactgtacttctatgatgtggacagcggcgacatgtggaccaatacctttatcgaggataaagcgggtaattggttctacctgggtaaggacggtgcggccgtcaccggtgcacagacgatcaaaggccagaaattgtatttcaaagccaacggtcagcaagttaaaggtgacattgtcaaggacgcggacggtaagatccgttattacgacgctcagaccggtgaacaggtctttaacaagtccgttagcgtcaacggtaagacctactatttcggtagcgacggcaccgcgcaaacccaggcgaatccgaaaggccaaacctttaaggatggtagcggcgttctgcgtttctacaatttggagggccagtatgtctcgggcagcggctggtacgaaacggccgagcacgagtgggtatatgtgaaatccggtaaagttctgaccggtgcccagacgattggtaatcaacgtgtttacttcaaggacaatggtcaccaggtgaaaggccagctggtcacgggtaatgacggtaaattgcgttactacgacgcgaacagcggtgatcaagcattcaacaaatccgtcacggttaacggtaaaacctactactttggcagcgatggtacggcgcagacgcaggctaatcctaagggtcagaccttcaaagatggtagcggcgtgctgcgtttttacaacttggaaggccaatacgtgtctggcagcggttggtacaagaatgcgcagggccagtggctgtacgtgaaagatggcaaggtcctgaccggtctgcaaacggtcggcaatcagaaggtctacttcgacaaaaatggcatccaagcaaagggtaaggccgttcgcacgtccgatggtaaagtgcgctactttgatgagaatagcggtagcatgattacgaaccaatggaagttcgtttacggtcaatactattacttcggttctgacggcgcagcggtttaccgtggttggaactaa

SEQ ID NO: 64 - protein, 1436 aa, Streptococcus downei
MVDGKYYYYDQDGNVKKNFAVSVGEKIYYFDETGAYKDTSKVEADKSGSDISKEETTFAANNRAYSTSAENFEAIDNYLTADSWYRPKSILKDGKTWTESSKDDFRPLLMAWWPDTETKRNYVNYMNKVVGIDKTYTAETSQADLTAAAELVQARIEQKITTEQNTKWLREAISAFVKTQPQWNGESEKPYDDHLQNGALKFDNQSDLTPDTQSNYRLLNRTPTNQTGSLDSRFTYNANDPLGGYELLLANDVDNSNPIVQAEQLNWLHYLLNFGTIYAKDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDLIRDIIKAEINPNAFGYSFTQDEIDQAFKIYNEDLKKTDKKYTHYNVPLSYTLLLTNKGSIPRVYYGDMFTDDGQYMANKTVNYDAIESLLKARMKYVAGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQASNKYLNVSDDKLFLPKTLLGQVVESGIRFDGTGYVYNSSTTGEKVTDSFITEAGNLYYFGQDGYMVTGAQNIKGSNYYFLANGAALRNTVYTDAQGQNHYYGNDGKRYENGYQQFGNDSWRYFKNGVMALGLTTVDGHVQYFDKDGVQAKDKIIVTRDGKVRYFDQHNGNAVTNTFVADKTGHWYYLGKDGVAVTGAQTVGKQHLYFEANGQQVKGDFVTAKDGKLYFYDVDSGDMWTNTFIEDKAGNWFYLGKDGAAVTGAQTIKGQKLYFKANGQQVKGDIVKDADGKIRYYDAQTGEQVFNKSVSVNGKTYYFGSDGTAQTQANPKGQTFKDGSGVLRFYNLEGQYVSGSGWYETAEHEWVYVKSGKVLTGAQTIGNQRVYFKDNGHQVKGQLVTGNDGKLRYYDANSGDQAFNKSVTVNGKTYYFGSDGTAQTQANPKGQTFKDGSGVLRFYNLEGQYVSGSGWYKNAQGQWLYVKDGKVLTGLQTVGNQKVYFDKNGIQAKGKAVRTSDGKVRYFDENSGSMITNQWKFVYGQYYYFGSDGAAVYRGWN

SEQ ID NO: 65 - protein, 1597 aa, Streptococcus dentrirousetti; identical to SEQ ID NO: 62

SEQ ID NO: 66 - DNA, 3972 bp, Streptococcus dentirousetti
atggttgacggcaaatactactactacgatgcagacggcaacgtaaagaaaaacttcgcggttagcgttggcgatgccattttctattttgatgaaacgggtgcctacaaagataccagcaaagttgatgcggataagaccagctctagcgtcaatcagaccacggaaacgttcgcagcgaataaccgtgcgtatagcaccgcagccgagaactttgaagcgattgataactacctgactgcggatagctggtatcgtccgaagtctatcttgaaagatggtacgacgtggaccgaaagcaccaaggatgattttcgcccgctgctgatggcgtggtggccggataccgaaaccaaacgtaactacgtgaactatatgaacaaggtggtcggtatcgacaaaacgtacaccgcggaaacgtcccaagctgacctgacggcggcagccgaactggtgcaggcgcgtatcgagcagaaaatcactagcgaaaagaatacgaagtggctgcgtgaggcgatttccgcgttcgttaagactcaaccgcagtggaatggcgagagcgagaaaccttatgatgaccacctgcaaaatggtgcgctgaagttcgacaatgaaaccagcctgaccccggatacgcagagcggctatcgcatcctgaaccgtaccccgacgaatcaaaccggtagcctggacccgcgcttcacctttaatcagaatgacccgctgggtggttatgagtatttgctggctaatgatgtcgataacagcaacccggtcgttcaggccgagagcctgaactggctgcattacctgctgaattttggtagcatttacgcgaatgatccggaggccaatttcgacagcatccgtgtggacgcggtggacaatgttgacgcagacctgctgcaaattagctcggattacctgaaatcggcgtacaaaattgacaagaacaacaaaaatgcgaacgaccacgttagcatcgtcgaggcgtggagcgacaatgataccccgtacctgaatgatgatggcgacaatctgatgaacatggataacaagtttcgtctgagcatgctgtggagcctggcgaagccaaccaatgtccgtagcggcttgaatccgctgatccacaacagcgtggttgaccgtgaggtggacgaccgtgaagttgaggctaccccgaattacagctttgcacgcgcacacgacagcgaagttcaagatttgattcgcgacatcatcaaagctgagatcaacccaaacagcttcggttatagctttacccaagaggaaatcgaccaggccttcaagatctacaatgaggatttgaagaaaaccaataagaagtatacccactacaacgtcccgctgagctacaccctgctgctgacgaacaagggcagcattccacgcatttactacggtgacatgtttacggatgacggtcagtatatggccaacaaaaccgttaactatgacgccattgagagcctgctgaaagcacgtatgaagtatgttagcggtggccaagcgatgcagaattacaacatcggcaacggcgagattctgaccagcgtccgttacggtaagggtgccctgaaacagagcgacaaaggcgataagactactcgtaccagcggtattggcgttgtgatgggtaaccagagcaatttcagcctggagggcaaggtggtggccctgaatatgggtgcaacgcataccaaacagaagtatcgtgcattgatggtgtctacggaaaccggcgtggcgatttacaatagcgatgaagaagcagaggcagcaggcctgatcaaaacgaccgatgagaatggttatttgtactttctgaatgacgatctgaagggcgtggctaacccgcaggtcagcggcttcctgcaagtgtgggttccggttggtgcaccggctgaccaggacattcgtgtggcggcgaccgatgcggcttctaccgacggtaagagcctgcatcaggacgcagctctggattctcgcgtcatgtttgaaggtttcagcaacttccagagcttcgcaaccaaggaagaggaatacaccaacgttgttattgcaaagaacgtggataagttcgtgagctggggtatcaccgacttcgagatggcaccgcagtacgttagctctaccgatggcacctttctggatagcgtgattcaaaatggctatgcctttacggaccgttacgacctgggtatgagcaaagcaaacaagtatggtactgctgaccaactggtggccgcgattaaagcgctgcatgcgaagggtctgcgtgtgatggcggattgggtcccagatcaaatgtacactttccctaagaaggaagtggttaccgttacccgtacggacaaatttggcaatccagtggcaggcagccaaatcaaccacaccttgtacgtcactgatactaagggtagcggtgacgactaccaggcgaagtacggtggcgcattcctggatgaactgaaagaaaagtacccggagctgtttaccaagaagcaaatcagcaccggtcaggcaatcgacccgagcgtgaaaatcaagcagtggagcgcgaagtacttcaacggtagcaatatcttgggtcgcggtgcgaactacgtgctgtccgaccaggcgtctaacaagtactttaacgtggccgaaggtaaagtctttctgccagcggcgatgctgggtaaggtcgtcgagagcggtatccgtttcgacggtaaaggttatatctataacagcagcaccactggcgaacaagtgaaggacagcttcattaccgaagcgggtaacttgtactattttggcaaagatggttatatggtcatgggtgcacagaatatccagggtgctaactactacttcttggcgaatggtgcggccctgcgcaatagcatcctgacggatcaggatggcaaaagccactattatgcaaatgacggcaagcgttatgagaacggctactatcaattcggtaacgactcctggcgctattttgaaaacggcgttatggccgttggtttgacgcgcgttgcgggccacgaccaatactttgataaggatggtatccaagcgaagaataagatcattgttacgcgtgacggtaaggtccgctacttcgacgaacacaacggcaatgctgccacgaatacgtttatcagcgatcaagccggccattggtactacctgggtaaagatggtgtcgccgtgacgggtgcgcagaccgttggcaagcaacacctgtacttcgaggctaacggccaacaagtaaaaggcgattttgttaccgccaaggacggtaagttgtattttctggacggtgactctggcgacatgtggaccgataccttcgtccaggataaggctggtcattggttctatctgggcaaagacggtgcggcggtaaccggtgcccagaccgtccgtggtcagaagctgtacttcaaagcgaatggccagcaggttaagggtgacattgtgaaaggcgcggatggtaaaatccgttactatgatgcaaattccggtgaccaggtttacaatcgcacggtgaaaggctccgacggcaagacctatatcattggtaatgacggcgtcgcaatcacgcaaaccatcgccaaaggccagaccatcaaggatggcagcgttctgcgcttctatagcatggagggtcagctggtgaccggcagcggctggtattccaacgcgaaaggtcaatggttgtatgtcaagaacggtcaagtcctgacgggtttgcagacggtgggcagccagcgtgtgtactttgacgcaaatggtattcaagcgaaaggtaaagcagtgcgtacctccgatggcaaactgcgttacttcgatgcgaacagcggcagcatgatcaccaatcagtggaaagaagttaatggtcagtactactatttcgacaacaacggtgttgcgatctatcgcggttggaactaa

SEQ ID NO: 67 - protein, 1323 aa, Streptococcus dentirousetti
MVDGKYYYYDADGNVKKNFAVSVGDAIFYFDETGAYKDTSKVDADKTSSSVNQTTETFAANNRAYSTAAENFEAIDNYLTADSWYRPKSILKDGTTWTESTKDDFRPLLMAWWPDTETKRNYVNYMNKVVGIDKTYTAETSQADLTAAAELVQARIEQKITSEKNTKWLREAISAFVKTQPQWNGESEKPYDDHLQNGALKFDNETSLTPDTQSGYRILNRTPTNQTGSLDPRFTFNQNDPLGGYEYLLANDVDNSNPVVQAESLNWLHYLLNFGSIYANDPEANFDSIRVDAVDNVDADLLQISSDYLKSAYKIDKNNKNANDHVSIVEAWSDNDTPYLNDDGDNLMNMDNKFRLSMLWSLAKPTNVRSGLNPLIHNSVVDREVDDREVEATPNYSFARAHDSEVQDLIRDIIKAEINPNSFGYSFTQEEIDQAFKIYNEDLKKTNKKYTHYNVPLSYTLLLTNKGSIPRIYYGDMFTDDGQYMANKTVNYDAIESLLKARMKYVSGGQAMQNYNIGNGEILTSVRYGKGALKQSDKGDKTTRTSGIGVVMGNQSNFSLEGKVVALNMGATHTKQKYRALMVSTETGVAIYNSDEEAEAAGLIKTTDENGYLYFLNDDLKGVANPQVSGFLQVWVPVGAPADQDIRVAATDAASTDGKSLHQDAALDSRVMFEGFSNFQSFATKEEEYTNVVIAKNVDKFVSWGITDFEMAPQYVSSTDGTFLDSVIQNGYAFTDRYDLGMSKANKYGTADQLVAAIKALHAKGLRVMADWVPDQMYTFPKKEVVTVTRTDKFGNPVAGSQINHTLYVTDTKGSGDDYQAKYGGAFLDELKEKYPELFTKKQISTGQAIDPSVKIKQWSAKYFNGSNILGRGANYVLSDQASNKYFNVAEGKVFLPAAMLGKVVESGIRFDGKGYIYNSSTTGEQVKDSFITEAGNLYYFGKDGYMVMGAQNIQGANYYFLANGAALRNSILTDQDGKSHYYANDGKRYENGYYQFGNDSWRYFENGVMAVGLTRVAGHDQYFDKDGIQAKNKIIVTRDGKVRYFDEHNGNAATNTFISDQAGHWYYLGKDGVAVTGAQTVGKQHLYFEANGQQVKGDFVTAKDGKLYFLDGDSGDMWTDTFVQDKAGHWFYLGKDGAAVTGAQTVRGQKLYFKANGQQVKGDIVKGADGKIRYYDANSGDQVYNRTVKGSDGKTYIIGNDGVAITQTIAKGQTIKDGSVLRFYSMEGQLVTGSGWYSNAKGQWLYVKNGQVLTGLQTVGSQRVYFDANGIQAKGKAVRTSDGKLRYFDANSGSMITNQWKEVNGQYYYFDNNGVAIYRGWN

SEQ ID NO: 68 - protein, 1619 aa, Lactobacillus reuteri
MELKKHFKLYKSGKQWVTAAVATIAFSAGVLTTSEVVHADTNTGDQQTEQVTQPSNSTTQDVKPVSTDASSDTKIVSDNKENNNQVGNTNVSGQNSSKDTKSVLTGTNSVTQNYDHNDNGNYGYIDSANLNNNQLQVSGWSATNQNINKDNHFIIAYDSTSQQELGRTKVETPVARPDVKAVHNVYNAENSGFNVNVSLNFDKMNNYRDAIKIISRYSGVPDGNSDYVDFVSQPIIFDENNYAHLDDFSVQNGKLHVSGWNATNKAIQNPNHFLILFDRTINREVARQKVTAGINRPDVEKAYPQVINANISGFDAAFDITTLNPNDEYQILSRYSNDDNGEGSYVTYWFKPQRIAPANQFNSGHLDSFNISKAGKVTVSGWQATNLSNIQSNRFIILFDNTANHQIASTKITNTARPDVEKVYPQVLNATNSGYDVTFDLTQDQIAQLLPNHSYSIVSRYSADANGNGNDKQHTDFWSTPITLNKTASYIDSISLNGNELNVRGWMASDASATQANPYLIVLNNGKEVTRQKLTLVARPDVAKVYPDVYSSLDSGFNTTIKLTVPQLNELTGNMQVLLRYSTAADGNPINNGGFTDQYSKNYATNGGSFDFVKVDNNQVAFSGWHVSDQATDKPYQWIIVLANGKEVGRQLISSTTNGFVSYNRPDVYNVNPAISNSSTSGFQGIMTLKDNIKNANVQLVHRFSDDGQNGEGNRVDYWSEVMPVTNTFQKGTDQLMRNLVAKPNKNQLKIYNGNTLVKTLGPGTWENMAFAQDSSAINNIDGYLSYTDWYRPYGTSQDGKTWYKTTAMDWRPLLMYIWPSKDVQAQFIKYFVNNGYENANYGLTKDTVANINKDTNTTVLANMAQNLRYVIEQSIAANKGTSKLANDINSFAATVPELSASSELSLQSMPNYRPDKSGTIDSDQVIFVNNNSKDPRKGNTSYADSNYRLMNRTINNQAGNNNSDNSPELLVGNDIDNSNPVVQAENLNWEYFLLNYGKLMGYNPDGNFDGFRVDAADNIDADVLDQMGQLMNDMYHTKGNPQNANDHLSYNEGYHSGAAQMLNEKGNPQLYMDSGEFYTLENVLGRANNRDNIGNLITNSIVNRQNDTTENEATPNWSFVTNHDQRKNLINRLIIKDHSNIPDIMGSAYKVEYANQAWQEFYADQEKTNKQYAQYNVPAQYAILLSNKDTVPQVYYGDLYNETAQYMQEKSIYYDAITTLMRARKQFVSGGQTMTKLNNNLLASVRYGKGVVDANSNGTDKLSRTSGMAVLVGNDSNMAQQSVAINMGRAHANQQYRNLIDTTENGLTYDADNSENPAILTTDSNGILKVTVKGYSNPYVSGYLGVWVPVISGDQDVTTNASDVVANKEKTFESNAALDSHMIYEDFSLFQPEPTSVENHAYNVIAKNASLFSDLGITDFWMAPAYTPFGRSRYNEGYSMTDRYNLGTTANPTKYGSGEELANTIAALHKAGLKVQEDIVMNQMIGFSGQEAVTVTRTNNRGMQIHVNGQTYANQIYFAYTTGGGNGQETYGGKYLAELQKNYPDLFTTKAISTGVAPDPTVRINKWSAKYQNGTSLQNIGIGLAVKLANGDYAYLNSGDNKAFNTLLPTAISLNFNN

SEQ ID NO: 69 - protein, 1620 aa, Lactobacillus reuteri
MEIKKHFKLYKSGKQWVTASIATFAVSTGLVLGGGVVHAADNHPTTTSASVTNTVNNLKPQNDPEQQNNTQESNTVEFPKKDSQDNAVQPLKETAVMPNATNKDGAKASITNNAHTDNTIYGNIDPTTINDKELHVTGWNATNQAINKNESRYVIAYDDTTNSELGRTKITNQIARPDVEKVHKDIYNAQNSGFNVNISLDFNKMNNYRDAIKIISRYSGVPNGNSDYVDFVSQPIIFDENNYAYLDDFSVQNGRLHVSGRNATNKAIQRPNHFLILFDRTVNREVARQKVTAGINRSDVEKVYPQVVNANVSGFDATFDTINLNPNHEYQILSRYSNNGDGEGDYVTYWFNPQRIAPVNQFNNGHLDNFDISKAGKVTVSGWQATNLSNIQNNRYIILFDTTANCQIASMKVTGVDRPDVAKVYPQILNANKSGYNVTFDLTQAQIAQLFPNHSYSIVSRYSADPNGNGNDKQHTDFWSAPIVLNKTASYIDDISLNGDVLNVKGWMASDASATQANPYIIILNNGKEVTRQKLTLNDRPDVAKVYPDVYNSLASGFDTTIKLTNSQLNALNGNMQILLRYSAAADGNPINNGGFTDQYSKNYATNGGSFDFVKVDNNQVAFSGWHVSDQATDKPYQWIIVLVNGKEVGRQLISSTTNGLVSYNRPDVYNVNPAISNSSTSGFQGIMTLKDNIKNANVQLVHRFSDDGQNGEGNRVDYWSEVMPVTNTFQKGTDQLMRNLVAKPNKNQLKIYNGNTLVKTLGPGTWENMAFAQDSSAINNIDGYLSYTGWYRPYGTSQDGKTWYETTAMDWRPLLMYIWPSKDVQAQFIKYFVNNGYENANYGLTESSVASFSKDTNANLLDVTAQNLRYVIEQSIAANKGTSKLANDINSFAATVPELSASSELSLQSMPNYRPDESGTVDSDQVIFVNNNSKDPRKGNTGYADSNYRLMNRTINNQAGNNNSDNSPELLVGNDIDNSNPVVQAENLNWEYFLLNYGKLMGYNPDGNFDGFRVDAADNIDADVLDQMGQLMNDMYHTKGNPQNANDHLSYNEGYHSGAAQMLNEKGNPQLYMDSGEFYTLENVLGRANNRDSIGNLITNSVVNRQNDTTENEATPNWSFVTNHDQRKNLINRLIIKGHPNIPDIMGSAYKAEYANQAWQEFYADQKKTNKQYDQYNVPAQYAILLSNKDTVPQVYYGDLYNETAQYMQEKSIYYDTITTLMKARKQFVSGGQTMTKLNNNLLASVRYGKGVADSNSNGTDKLSRTSGIAVLVGNDSNMAQQTVAINMGRAHANQQYRNLIDTTENGLTYDGENSENPAILTTDSNGILKVTVKGYSNPYVSGYLGVWVPVISGDQDVTTSASDVVADKEKTFESNAALDSHMIYEDFSLFQPEPTNVENHAYNVIAKNANLFNDLGITDFWMAPAYTPFGMSRYNEGYSMTDRYNLGTTANPTKYGSGEELANTIAALHKVGLKVQEDIVMNQMIGFSGQEAVTVTRTNNRGMQIHVNGQTYANQIYFAYTTGGGNGQETYGGKYLAELQKNYPDLFTTKAISTEVVPDPTVRINKWSAKYENGTSLQNIGIGLAVKLANGDYAYLNSGDNKAFNTLLPTAISLNFNN

SEQ ID NO: 70 - protein, 1488 aa, Lactobacillus reuteri
MDIKKHFKLYKSGKQWFTAAIITAVSAGLILNLGGVASADSATNANDNVAVNQPAAQTSENIKSVSSNASTNDVTNNQKAQKVQSPKSINPKADNSNQQQNRWVKNAQGQMEYYQNNQLLKGRQYVNLPTIPNTNVQTDNNWYLVDNGIAQSGVQQWAGSYYYFNPSTYLRVDNEYRQSQWGDWYMFGKDGRAVTGLYDYNGNTYYANPTTYLRETNKYISTSKGNMLLGNDGAALSGIQSVNGKYYYFDPVTHLQANKENYVQSQWGDWYLIGNDGQVLSGVQQWAGTYYYFDPTTYLRVDNDYRQSQWGLWYMFGHDGRIVTKVYPWAGTYYYFDPTTYLRVDNAYLQSQWGDWYLFGNDGRIQSGVQRWAGTYYYFDPTTYLRVDNDYVTSQWGSKYMFGPDGRIVTGLYKWSKNNQLYYFDPVTYLAVTNNYIKANNGNWYLFTADGTAASKVAPWAGSYYYFDPVTHLRVDNAYVQSQWGDWYMFGPDGRIVTGLKEWYGSYYYFDPTTYLKVTNKWIDNKYFGPDGRQAISSLENINNKFYCFDGNGQIIRNQFKKIDTHTYYFGSDGAALVGKQTIDGKNYHFASNGQLLGNLYGKIVDGKFNIYDSLSNKLIKTLDSGDWENMAYSQDSSSINNTDGYLSYSGWYRPYGTSQDGKTWYKTTASDWRPLLMYTWPSKDVEAKFIKYFVDNGYTNTDYGLTKDNVTNLSQDTDTQTLNKYARNLRFVIEKSIAANKSTGPLANDINKFMLTIPELSAKSELPVEYSNGYVPDVSGSIDNNQLIFINNNSDNQAKGNTSYADSNYRLMNRTINNQTNNDNSDQSPELLVGNDIDNSNPAVQAENFNWEYFLLNYGKLMKYNADGNFDGFRVDAADNIDADVLDQLGQLVNDMYHTKGNQENANNHLVYNEGYHSGAARMLNDKGNPELFMDAGYFYTLENVLGQAENKRDNVNNLITNSVVNRANDITENTATPNWSFVTNHDQRKNVINQIIIDNHPNIPDIMANSYKSTYAQKAWDEFYADQAKADKKYAQYNLPAQYALLLSNKDTVPQVYYGDLYKETDQYMKTKSMYYDAITTLMKARGEFVNGGQTMTKVNDNLITSVRYGKGVVDVSSNGTDPLSRTTGMAVIVGNNPSMSEQVVAINMGLAHANEQYRNLIDSTADGLTYNSNGSVNPSVLTTDSKGILRVTVKGYSNPYVSGYLSVWVPLINGTQNARTSAQEVRNVPGKVFTSNAALDSHMIYEDFSLFQPEPTTVNEHAYNVIKDNVALFNQLGITDFWMAPSYTPFNTSRYNEGYAMTDRYNLGTADNPTKYGNGEELSNAIAALHQAGLKVQEDLVMNQMIGFSTQEAVTVTRVDRDAKQLSVDGQTFADQIYFGYTRGGGQGQQDYGGKYLAELKQKYPDLFTTKAASTGVAPDPNTRITEWSAKYENGTSLQNVGIGLAVKMPNGYYAYLNDGNNKAFATTLPDAISSADYYANQENI

SEQ ID NO: 71 - protein, 636 aa, Neisseria polysaccharea
MLTPTQQVGLILQYLKTRILDIYTPEQRAGIEKSEDWRQFSRRMDTHFPKLMNELDSVYGNNEALLPMLEMLLAQAWQSYSQRNSSLKDIDIARENNPDWILSNKQVGGVCYVDLFAGDLKGLKDKIPYFQELGLTYLHLMPLFKCPEGKSDGGYAVSSYRDVNPALGTIGDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMLFLANLGVDILRMDAVAFIWKQMGTSCENLPQAHALIRAFNAVMRIAAPAVFFKSEAIVHPDQVVQYIGQDECQIGYNPLQMALLWNTLATREVNLLHQALTYRHNLPEHTAWVNYVRSHDDIGWTFADEDAAYLGISGYDHRQFLNRFFVNRFDGSFARGVPFQYNPSTGDCRVSGTAAALVGLAQDDPHAVDRIKLLYSIALSTGGLPLIYLGDEVGTLNDDDWSQDSNKSDDSRWAHRPRYNEALYAQRNDPSTAAGQIYQGLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

What is claimed is:

1. A method to produce an alpha-glucan, said method comprising:
    (a) combining at least sucrose and an isolated polypeptide comprising an amino acid sequence having at least 95% identity to SEQ ID NO:10 under suitable aqueous reaction conditions to catalyze synthesis of water-soluble alpha-glucan comprising 100% alpha-1,6 glycosidic linkages, and
    (b) optionally isolating the water-soluble alpha-glucan produced in step (a).

2. The method of claim 1, wherein the polypeptide comprises an amino acid sequence having at least 96% identity to SEQ ID NO:10.

3. The method of claim 1, wherein the polypeptide comprises an amino acid sequence having at least 97% identity to SEQ ID NO:10.

4. The method of claim 1, wherein the method comprises step (b) of isolating the water-soluble alpha-glucan produced in step (a).

5. The method of claim 1, wherein the polypeptide comprises an amino acid sequence having at least 98% identity to SEQ ID NO:10.

6. The method of claim 1, wherein the polypeptide comprises an amino acid sequence having at least 99% identity to SEQ ID NO:10.

* * * * *